US007517864B2

(12) United States Patent
Vargeese et al.

(10) Patent No.: US 7,517,864 B2
(45) Date of Patent: Apr. 14, 2009

(54) RNA INTERFERENCE MEDIATED INHIBITION OF VASCULAR ENDOTHELIAL GROWTH FACTOR AND VASCULAR ENDOTHELIAL GROWTH FACTOR RECEPTOR GENE EXPRESSION USING SHORT INTERFERING NUCLEIC ACID (SINA)

(75) Inventors: Chandra Vargeese, Broomfield, CO (US); Vasant Jadhav, Longmont, CO (US); David Morrissey, Boulder, CO (US)

(73) Assignee: Sirna Therapeutics, Inc., San Francisco, CA (US)

( * ) Notice: Subject to any disclaimer, the term of this patent is extended or adjusted under 35 U.S.C. 154(b) by 0 days.

(21) Appl. No.: 11/299,391

(22) Filed: Dec. 9, 2005

(65) Prior Publication Data
US 2006/0217332 A1 Sep. 28, 2006

Related U.S. Application Data

(63) Continuation-in-part of application No. 10/962,898, filed on Oct. 12, 2004, now abandoned, which is a continuation-in-part of application No. 10/944,611, filed on Sep. 16, 2004, now abandoned, which is a continuation-in-part of application No. 10/844,076, filed on May 11, 2004, now Pat. No. 7,176,304, which is a continuation-in-part of application No. 10/831,620, filed on Apr. 23, 2004, which is a continuation-in-part of application No. 10/764,957, filed on Jan. 26, 2004, now abandoned, which is a continuation-in-part of application No. 10/670,011, filed on Sep. 23, 2003, now abandoned, which is a continuation-in-part of application No. 10/665,255, filed on Sep. 16, 2003, now abandoned, and a continuation-in-part of application No. 10/664,767, filed on Sep. 16, 2003, now abandoned, which is a continuation-in-part of application No. PCT/US03/05022, filed on Feb. 20, 2003, said application No. 10/665,255 is a continuation-in-part of application No. PCT/US03/05022, filed on Feb. 20, 2003, application No. 11/299,391, which is a continuation-in-part of application No. PCT/US2004/016390, filed on May 24, 2004, which is a continuation-in-part of application No. 10/826,966, filed on Apr. 16, 2004, now abandoned, which is a continuation-in-part of application No. 10/757,803, filed on Jan. 14, 2004, which is a continuation-in-part of application No. 10/720,448, filed on Nov. 24, 2003, which is a continuation-in-part of application No. 10/693,059, filed on Oct. 23, 2003, which is a continuation-in-part of application No. 10/444,853, filed on May 23, 2003, which is a continuation-in-part of application No. PCT/US03/05346, filed on Feb. 20, 2003, and a continuation-in-part of application No. PCT/US03/05028, filed on Feb. 20, 2003, application No. 11/299,391, which is a continuation-in-part of application No. PCT/US2004/013456, filed on Apr. 30, 2004, which is a continuation-in-part of application No. 10/780,447, filed on Feb. 13, 2004, which is a continuation-in-part of application No. 10/427,160, filed on Apr. 30, 2003, which is a continuation-in-part of application No. PCT/US02/15876, filed on May 17, 2002, application No. 11/299,391, which is a continuation-in-part of application No. 10/727,780, filed on Dec. 3, 2003, now abandoned, said application No. 10/962,898 is a continuation-in-part of application No. 10/922,675, filed on Aug. 20, 2004, which is a continuation-in-part of application No. 10/863,973, filed on Jun. 9, 2004, which is a continuation-in-part of application No. PCT/US03/04566, filed on Feb. 14, 2003.

(51) Int. Cl.
*A61K 48/00* (2006.01)
*C07H 21/02* (2006.01)
*C07H 21/04* (2006.01)

(52) U.S. Cl. .................. 514/44; 536/23.1; 536/24.3; 536/24.5

(58) Field of Classification Search .................. None
See application file for complete search history.

(56) References Cited

U.S. PATENT DOCUMENTS 4,501,729 A    2/1985   Boucher et al.

(Continued)

FOREIGN PATENT DOCUMENTS

| AU | 2001240375 | 3/2001 |
| CA | 2359180 | 8/2000 |

(Continued)

OTHER PUBLICATIONS

Scherer et al., Approaches for the sequence-specific knockdown of mRNA, 2003, Nat. Biotechnol., 21(12), pp. 1457-1465.*

(Continued)

*Primary Examiner*—Amy Bowman
(74) *Attorney, Agent, or Firm*—McDonnell Boehnen Hulbert & Berghoff LLP

(57) ABSTRACT

This invention relates to compounds, compositions, and methods useful for modulating VEGF and/or VEGFR gene expression using short interfering nucleic acid (siNA) molecules. This invention also relates to compounds, compositions, and methods useful for modulating the expression and activity of other genes involved in pathways of VEGF and/or VEGFR gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of VEGF and/or VEGFR genes. The application also relates to methods of treating diseases and conditions associated with VEGF and/or VEGFR gene expression, such as ocular diseases and conditions, including age related macular degeneration (AMD) and diabetic retinopathy, as well as providing dosing regimens and treatment protocols.

16 Claims, 38 Drawing Sheets

U.S. PATENT DOCUMENTS

| | | |
|---|---|---|
| 4,987,071 A | 1/1991 | Cech et al. |
| 5,108,921 A | 4/1992 | Low et al. |
| 5,138,045 A | 8/1992 | Cook et al. |
| 5,214,136 A | 5/1993 | Lin et al. |
| 5,334,711 A | 8/1994 | Sproat |
| 5,416,016 A | 5/1995 | Low et al. |
| 5,421,818 A | 6/1995 | Arenberg |
| 5,474,529 A | 12/1995 | Arenberg |
| 5,476,446 A | 12/1995 | Arenberg |
| 5,572,594 A | 11/1996 | Devoe et al. |
| 5,587,471 A | 12/1996 | Cook et al. |
| 5,589,332 A | 12/1996 | Shih et al. |
| 5,624,803 A | 4/1997 | Noonberg et al. |
| 5,627,053 A | 5/1997 | Usman et al. |
| 5,631,359 A | 5/1997 | Chowrira et al. |
| 5,631,360 A | 5/1997 | Usman et al. |
| 5,633,133 A | 5/1997 | Long et al. |
| 5,670,633 A | 9/1997 | Cook et al. |
| 5,672,695 A | 9/1997 | Eckstein et al. |
| 5,716,824 A | 2/1998 | Beigelman et al. |
| 5,741,679 A | 4/1998 | George et al. |
| 5,792,847 A | 8/1998 | Buhr et al. |
| 5,804,683 A | 9/1998 | Usman et al. |
| 5,814,620 A | 9/1998 | Robinson et al. |
| 5,831,071 A | 11/1998 | Usman et al. |
| 5,834,186 A | 11/1998 | George et al. |
| 5,849,902 A | 12/1998 | Arrow et al. |
| 5,854,038 A | 12/1998 | Sullenger et al. |
| 5,871,914 A | 2/1999 | Nathan et al. |
| 5,889,136 A | 3/1999 | Scaringe et al. |
| 5,898,031 A | 4/1999 | Crooke |
| 5,902,880 A | 5/1999 | Thompson et al. |
| 5,916,763 A | 6/1999 | Williams et al. |
| 5,968,909 A | 10/1999 | Agrawal et al. |
| 5,989,912 A | 11/1999 | Arrow et al. |
| 5,998,148 A | 12/1999 | Bennett et al. |
| 5,998,203 A | 12/1999 | Matulic-Adamic et al. |
| 5,998,206 A | 12/1999 | Cowsert |
| 6,001,311 A | 12/1999 | Brennan |
| 6,005,087 A | 12/1999 | Cook et al. |
| 6,008,400 A | 12/1999 | Scaringe et al. |
| 6,045,528 A | 4/2000 | Arenberg |
| 6,054,576 A | 4/2000 | Bellon et al. |
| 6,060,456 A | 5/2000 | Arnold et al. |
| 6,107,094 A | 8/2000 | Crooke |
| 6,111,086 A | 8/2000 | Scaringe |
| 6,117,657 A | 9/2000 | Usman et al. |
| 6,120,484 A | 9/2000 | Silverstein |
| 6,146,886 A | 11/2000 | Thompson |
| 6,153,737 A | 11/2000 | Manoharan et al. |
| 6,162,909 A | 12/2000 | Bellon et al. |
| 6,168,778 B1 | 1/2001 | Janjic et al. |
| 6,180,613 B1 | 1/2001 | Kaplitt et al. |
| 6,214,805 B1 | 4/2001 | Torrence et al. |
| 6,235,310 B1 | 5/2001 | Wang et al. |
| 6,235,886 B1 | 5/2001 | Manoharan et al. |
| 6,248,878 B1 | 6/2001 | Adamic et al. |
| 6,300,074 B1 | 10/2001 | Gold et al. |
| 6,303,773 B1 | 10/2001 | Bellon et al. |
| 6,335,434 B1 | 1/2002 | Guzaev et al. |
| 6,346,398 B1 | 2/2002 | Pavco et al. |
| 6,350,934 B1 | 2/2002 | Zwick et al. |
| 6,353,098 B1 | 3/2002 | Usman et al. |
| 6,362,323 B1 | 3/2002 | Usman et al. |
| 6,395,492 B1 | 5/2002 | Manoharan et al. |
| 6,395,713 B1 | 5/2002 | Beigelman et al. |
| 6,437,117 B1 | 8/2002 | Usman et al. |
| 6,440,102 B1 | 8/2002 | Armstrong et al. |
| 6,447,796 B1 | 9/2002 | Vook et al. |
| 6,469,158 B1 | 10/2002 | Usman et al. |
| 6,476,205 B1 | 11/2002 | Buhr et al. |
| 6,506,559 B1 * | 1/2003 | Fire et al. ............... 435/6 |
| 6,528,631 B1 | 3/2003 | Cook et al. |
| 6,565,885 B1 | 5/2003 | Tarara et al. |
| 6,573,099 B2 | 6/2003 | Graham et al. |
| 6,582,728 B1 | 6/2003 | Platz et al. |
| 6,586,524 B2 | 7/2003 | Sagara |
| 6,592,904 B2 | 7/2003 | Platz et al. |
| 6,617,156 B1 | 9/2003 | Doucette-Stamm et al. |
| 6,685,697 B1 | 2/2004 | Arenberg et al. |
| 6,710,174 B2 | 3/2004 | Bennett et al. |
| 6,762,290 B1 * | 7/2004 | Janjic et al. ............ 536/23.1 |
| 6,824,972 B2 | 11/2004 | Kenwrick et al. |
| 7,022,828 B2 | 4/2006 | McSwiggen et al. |
| 7,078,196 B2 | 7/2006 | Tuschl et al. |
| 2001/0007666 A1 | 7/2001 | Hoffman et al. |
| 2002/0086356 A1 | 7/2002 | Tuschl et al. |
| 2002/0130430 A1 | 9/2002 | Caster |
| 2002/0137210 A1 | 9/2002 | Churikov |
| 2002/0151693 A1 | 10/2002 | Breaker et al. |
| 2003/0045830 A1 * | 3/2003 | de Bizemont et al. ....... 604/20 |
| 2003/0059944 A1 | 3/2003 | Lois-Caballe et al. |
| 2003/0064945 A1 | 4/2003 | Akhtar et al. |
| 2003/0077829 A1 | 4/2003 | MacLachlan |
| 2003/0143732 A1 | 7/2003 | Fosnaugh et al. |
| 2003/0190635 A1 | 10/2003 | McSwiggen et al. |
| 2003/0206887 A1 | 11/2003 | Morrissey et al. |
| 2004/0018176 A1 | 1/2004 | Tolentino et al. |
| 2004/0019001 A1 | 1/2004 | McSwiggen |
| 2004/0037780 A1 | 2/2004 | Parsons et al. |
| 2004/0161844 A1 | 8/2004 | Baker et al. |
| 2004/0209832 A1 | 10/2004 | McSwiggen et al. |
| 2005/0020521 A1 | 1/2005 | Rana |
| 2005/0171039 A1 | 8/2005 | McSwiggen et al. |
| 2005/0182005 A1 | 8/2005 | Tuschl et al. |
| 2005/0227256 A1 | 11/2005 | Hutvagner et al. |
| 2005/0260617 A1 | 11/2005 | Saigo et al. |

FOREIGN PATENT DOCUMENTS

| | | |
|---|---|---|
| EP | 0 360 257 | 2/1990 |
| EP | 1144623 | 1/2002 |
| EP | 1389637 | 8/2002 |
| EP | 1325955 | 7/2003 |
| JP | 08208687 | 8/1996 |
| WO | 88/09810 | 12/1988 |
| WO | 89/02439 | 3/1989 |
| WO | 90/12096 | 10/1990 |
| WO | 90/14090 | 11/1990 |
| WO | 91/03162 | 3/1991 |
| WO | 92/07065 | 4/1992 |
| WO | 93/15187 | 8/1993 |
| WO | 93/23569 | 11/1993 |
| WO | 94/01550 | 1/1994 |
| WO | 94/02595 | 2/1994 |
| WO | 94/11499 | 5/1994 |
| WO | 94/21791 | 9/1994 |
| WO | 95/04142 | 2/1995 |
| WO | 95/06731 | 3/1995 |
| WO | 95/11304 | 4/1995 |
| WO | 95/11910 | 5/1995 |
| WO | 95/13380 | 5/1995 |
| WO | 96/10390 | 4/1996 |
| WO | 96/10391 | 4/1996 |
| WO | 96/10392 | 4/1996 |
| WO | 96/18736 | 6/1996 |
| WO | 96/22689 | 8/1996 |
| WO | 97/00957 | 1/1997 |
| WO | 97/18312 | 5/1997 |
| WO | 97/21808 | 6/1997 |
| WO | 97/26270 | 7/1997 |
| WO | 98/13526 | 4/1998 |
| WO | 98/27104 | 6/1998 |
| WO | 98/28317 | 7/1998 |

| | | |
|---|---|---|
| WO | 98/43993 | 10/1998 |
| WO | 98/58058 | 12/1998 |
| WO | 99/04819 | 2/1999 |
| WO | 99/05094 | 2/1999 |
| WO | 99/07409 | 2/1999 |
| WO | 99/14226 | 3/1999 |
| WO | 99/16871 | 4/1999 |
| WO | 99/17120 | 4/1999 |
| WO | 99/29842 | 6/1999 |
| WO | 99/31262 | 6/1999 |
| WO | 99/32619 | 7/1999 |
| WO | 99/49029 | 9/1999 |
| WO | 99/53050 | 10/1999 |
| WO | 99/54459 | 10/1999 |
| WO | 99/55857 | 11/1999 |
| WO | 99/61631 | 12/1999 |
| WO | 99/66063 | 12/1999 |
| WO | 00/01846 | 1/2000 |
| WO | 00/03683 | 1/2000 |
| WO | 00/17369 | 3/2000 |
| WO | 00/24931 | 5/2000 |
| WO | 00/26226 | 5/2000 |
| WO | 00/44895 | 8/2000 |
| WO | 00/44914 | 8/2000 |
| WO | 00/49035 | 8/2000 |
| WO | 00/53722 | 9/2000 |
| WO | 00/63364 | 10/2000 |
| WO | 00/66604 | 11/2000 |
| WO | 01/04313 | 1/2001 |
| WO | 01/29058 | 4/2001 |
| WO | 01/36646 | 5/2001 |
| WO | 01/38551 | 5/2001 |
| WO | 01/42443 | 6/2001 |
| WO | 01/49844 | 7/2001 |
| WO | 01/53475 | 7/2001 |
| WO | 01/68836 | 9/2001 |
| WO | 01/70944 | 9/2001 |
| WO | 01/70949 | 9/2001 |
| WO | 01/72774 | 10/2001 |
| WO | 01/75164 | 10/2001 |
| WO | 01/92513 | 12/2001 |
| WO | 01/96584 | 12/2001 |
| WO | 01/97850 | 12/2001 |
| WO | 02/07747 | 1/2002 |
| WO | 02/10378 | 2/2002 |
| WO | 02/15876 | 2/2002 |
| WO | 02/22636 | 3/2002 |
| WO | 02/38805 | 5/2002 |
| WO | 02/44321 | 6/2002 |
| WO | 02/055692 | 7/2002 |
| WO | 02/055693 | 7/2002 |
| WO | 02/087541 | 11/2002 |
| WO | 02/094185 | 11/2002 |
| WO | 02/096927 | 12/2002 |
| WO | 03/070744 | 2/2003 |
| WO | 03/070910 | 2/2003 |
| WO | 03/024420 | 3/2003 |
| WO | 03/030989 | 4/2003 |
| WO | 03/043689 | 5/2003 |
| WO | 03/044188 | 5/2003 |
| WO | 03/046185 | 6/2003 |
| WO | 03/047518 | 6/2003 |
| WO | 03/064625 | 8/2003 |
| WO | 03/064626 | 8/2003 |
| WO | 03/068797 | 8/2003 |
| WO | 03/070887 | 8/2003 |
| WO | 03/070896 | 8/2003 |
| WO | 03/070918 | 8/2003 |
| WO | 03/074654 | 9/2003 |
| WO | 03/080638 | 10/2003 |
| WO | PCT/US03/186920 | 10/2003 |
| WO | PCT/US03/216335 | 11/2003 |
| WO | 03/099298 | 12/2003 |
| WO | 03/104456 | 12/2003 |
| WO | 2004/009769 | 1/2004 |
| WO | 2004/013280 | 2/2004 |
| WO | 2004/029212 | 4/2004 |
| WO | PCT/US2004/013456 | 4/2004 |
| WO | 2004/043977 | 5/2004 |
| WO | PCT/US2004/016390 | 5/2004 |
| WO | 2004/048566 | 6/2004 |
| WO | 2004/072261 | 8/2004 |
| WO | 2004/090105 | 10/2004 |
| WO | PCT/US2005/054596 | 3/2005 |
| WO | 2005/049821 | 6/2005 |

OTHER PUBLICATIONS

Mahato et al., Modulation of gene expression by antisense and antigene oligodeoxynucleotides and small interfering RNA, Jan. 2005, Expert Opinion on Drug Delivery, vol. 2, No. 1, pp. 3-28.*
Smith et al., Immunolocalisation of the VEGF receptors FLT-1, KDR, and FLT-4 in diabetic retinopathy, 1999, Br J Ophthalmol., 83(4), pp. 486-494.*
Ambion (http://www.ambion.com/techlib/misc/siRNA_finder. html, available 2002 to the public, siRNA hit printout included.*
Hammond et al., Post-Transcriptional Gene Silencing by Double-Stranded RNA, 2001, Nature Reviews, Genetics, vol. 2, pp. 110-119.*
U.S. Appl. No. 09/226,044, filed Jul. 12, 2001, Hoffman et al.
U.S. Appl. No. 09/301,511, filed Apr. 28, 1999, Beigleman et al.
U.S. Appl. No. 09/740,332, filed Dec. 18, 2000, Blatt et al.
U.S. Appl. No. 09/800,594, filed Mar. 6, 2001, Usman and McSwiggen.
U.S. Appl. No. 10/151,116, filed May 17, 2002, Matulic-Adamic et al.
U.S. Appl. No. 10/201,394, filed Aug. 13, 2001, Vargeese et al.
U.S. Appl. No. 10/224,005, filed Aug. 20, 2002, McSwiggen et al.
U.S. Appl. No. 10/287,949, filed Nov. 4, 2002, Pavco.
U.S. Appl. No. 10/306,747, filed Nov. 27, 2002, Pavco.
U.S. Appl. No. 10/417,012, filed Apr. 16, 2003, McSwiggen et al.
U.S. Appl. No. 10/422,704, filed Apr. 24, 2003, McSwiggen et al.
U.S. Appl. No. 10/427,160, filed Apr. 30, 2003, Vargeese et al.
U.S. Appl. No. 10/438,493, filed May 15, 2003, Pavco et al.
U.S. Appl. No. 10/444,853, filed May 23, 2003, McSwiggen et al.
U.S. Appl. No. 10/652,791, filed Aug. 29, 2003, McSwiggen et al.
U.S. Appl. No. 10/664,668, filed Sep. 18, 2003, McSwiggen et al.
U.S. Appl. No. 10/664,767, filed Sep. 16, 2003, McSwiggen et al.
U.S. Appl. No. 10/665,255, filed Sep. 16, 2003, McSwiggen et al.
U.S. Appl. No. 10/665,951, filed Sep. 18, 2003, McSwiggen et al.
U.S. Appl. No. 10/670,011, filed Sep. 23, 2003, McSwiggen et al.
U.S. Appl. No. 10/693,059, filed Oct. 23, 2003, McSwiggen et al.
U.S. Appl. No. 10/712,633, filed Nov. 13, 2003, McSwiggen et al.
U.S. Appl. No. 10/720,448, filed Nov. 24, 2003, McSwiggen et al.
U.S. Appl. No. 10/727,780, filed Dec. 3, 2003, Vaish et al.
U.S. Appl. No. 10/757,803, filed Jan. 14, 2004, McSwiggen et al.
U.S. Appl. No. 10/758,155, filed Jan. 12, 2004, McSwiggen et al.
U.S. Appl. No. 10/764,957, filed Jan. 26, 2004, Pavco et al.
U.S. Appl. No. 10/780,447, filed Feb. 13, 2004, Vargeese et al.
U.S. Appl. No. 10/826,966, filed Apr. 16, 2004, McSwiggen et al.
U.S. Appl. No. 10/831,620, filed Apr. 23, 2004, McSwiggen et al.
U.S. Appl. No. 10/844,076, filed May 11, 2004, McSwiggen et al.
U.S. Appl. No. 10/863,973, filed Jun. 9, 2004, Richards et al.
U.S. Appl. No. 10/919,866, filed Aug. 17, 2004, Richards et al.
U.S. Appl. No. 10/922,675, filed Jul. 7, 2004, McSwiggen et al.
U.S. Appl. No. 10/923,182, filed Aug. 20, 2004, McSwiggen et al.
U.S. Appl. No. 10/923,329, filed Aug. 20, 2004, McSwiggen et al.
U.S. Appl. No. 10/923,536, filed Aug. 2, 2004, McSwiggen et al.
U.S. Appl. No. 10/944,611, filed Sep. 16, 2004, Richards et al.
U.S. Appl. No. 10/962,898, filed Oct. 12, 2004, Richards et al.
U.S. Appl. No. 10/981,966, filed Nov. 5, 2004, Vargeese et al.
U.S. Appl. No. 60/082,404, filed Apr. 20, 1998, Thompson et al.
U.S. Appl. No. 60/292,217, filed May 18, 2001, Beigelman et al.
U.S. Appl. No. 60/306,883, filed Jul. 20, 2001, Vargeese et al.
U.S. Appl. No. 60/311,865, filed Aug. 13, 2001, Vargeese et al.
U.S. Appl. No. 60/334,461, filed Nov. 30, 2001, Pavco et al.

U.S. Appl. No. 60/358,580, filed Feb. 20, 2002, Beigelman et al.
U.S. Appl. No. 60/362,016, filed Mar. 6, 2002, Matulic-Adamic et al.
U.S. Appl. No. 60/363,124, filed Mar. 11, 2002, Beigelman et al.
U.S. Appl. No. 60/386,782, filed Jun. 6, 2002, Beigelman et al.
U.S. Appl. No. 60/393,796, filed Jul. 3, 2002, Pavco et al.
U.S. Appl. No. 60/399,348, filed Jul. 29, 2002, McSwiggen et al.
U.S. Appl. No. 60/402,996, filed Aug. 13, 2002, Usman et al.
U.S. Appl. No. 60/406,784, filed Aug. 29, 2002, Beigelman et al.
U.S. Appl. No. 60/408,378, filed Sep. 5, 2002, Beigelman et al.
U.S. Appl. No. 60/409,293, filed Sep. 9, 2002, Beigelman et al.
U.S. Appl. No. 60/440,129, filed Jan. 15, 2003, Beigelman et al.
U.S. Appl. No. 60/543,480, filed Feb. 10, 2004, Jadhati et al.
U.S. Appl. No. 60/678,531, filed May 6, 2005, Vargeese et al.
U.S. Appl. No. 60/703,946, filed Jul. 29, 2005, Vargeese et al.
U.S. Appl. No. 60/737,024, filed Nov. 15, 2005, Vargeese et al.
Abramovitz et al., "Catalytic Role of 2'-Hydroxyl Groups Within a Group II Intron Active Site," *Science* 271:1410-1413 (1996).
Adah et al., "Chemistry and Biochemistry of 2',5'-Oligoadenylate-Based Antisense Strategy," *Current Medicinal Chemistry*, 8, 1189-1212 (2001).
Aiello et al., "Vascular Endothelial Growth Factor in Ocular Fluid of Patients with Diabetic Retinopathy and Other Retinal Disorders," The New England Journal of Medicine 331(22):1480-1487 (1994).
Akhtar and Juliano, "Cellular Uptake and Intracellular Fate of AntiSense Oligonucleotides," *Trends Cell Biol.* 2:139-144 (1992).
Aldrian-Herrada et al., "A peptide nucleic acid (PNA) is more rapidly internalized in cultured neurons when coupled to a *retro-inverso* delivery peptide. The antisense activity depresses the target mRNA and protein in magnocellular oxytocin neurons," *Nucleic Acids Research* 26:4910-4916 (1998).
Allshire, "RNAi and Heterochromatin—A Hushed-up Affair," *Science* 297:1818-1819 (2002).
Ambros, Victor, "The functions of animal microRNAs", *Nature*, 431, 350-355 (2004).
Anderson et al., "Bispecific Short Hairpin siRNA Constructs Targeted to CD4, CXCR4, and CCR5 Confer HIV-1 Resistance," Oligonucleotides, 13:303-312 (2003).
Andrews and Faller, "A rapid micropreparation technique for extraction of DNA-binding proteins from limiting numbers of mammalian cells," *Nucleic Acids Research* 19:2499 (1991).
Antopolsky et al., "Peptide-Oligonucleotide Phosphorothioate Conjugates with Membrane Translocation and Nuclear Localization Properties," *Bioconjugate Chem.* 10:598-606 (1999).
Arap et al., "Cancer Treatment by Targeted Drug Delivery to Tumor Vasculature in a Mouse Model," *Science* 279:377-380 (1998).
Autiero et al., "Role of PIGF in ther intra- and intermolecular cross talk between the VEGF receptors Flt1 and Flk1," *Nature Medicine*, 9:936-943 (2003).
Baenziger and Fiete, "Galactose and N-Acetylgalactosamine-Specific Endocytosis of Glycopeptides by Isolated Rat Hepatocytes," Cell 22:611-620 (1980).
Bahramian et al., "Transcriptional and Posttranscriptional Silencing of Rodent α1(l) Collagen by a Homologous Transcriptionally Self-Silenced Transgene," *Molecular and Cellular Biology*, 19:274-283 (1999).
Banerjee and Turner, "The Time Dependence of Chemical Modification Reveals Slow Steps in the Folding of a Group 1 Ribozyme," *Biochemistry* 34:6504-6512 (1995).
Bannai et al., "Effect of Injection of Antisense of Oligodeoxynucleotides of GAD Isozymes into Rat Ventromedial Hypothalamus on Food Intake and Locomotor Activity," *Brain Research* 784:305-315 (1998).
Bannai et al., "Water-absorbent Polymer as a Carrier for a Discrete Deposit of Antisense Oligodeoxynucleotides in the Central Nervous System," *Brain Research Protocols* 3:83-87 (1998).
Bartel and Szostak, "Isolation of New Ribozymes from a Large Pool of Random Sequences," *Science* 261:1411-1418 (1993).
Bartel, "MicroRNAs: Genomics, Biogenesis, Mechanism, and Function," *Cell*, 116, 281-297 (2004).
Basi et al., "Antagonistic Effects of β-Site Amyloid Precursor Prtein-cleaving Enzymes 1 and 2 on β-Amyloid Peptide Production in Cells*, " *The Journal of Biological Chemistry*, 278, 31512-31520 (2003).

Bass, "Double-Stranded RNA as a Template for Gene Silencing," *Cell*, 101, 235-238 (2000).
Bass, "The short answer," *Nature* 411:428-429 (2001).
Bayard et al., "Increased stability and antiviral activity of 2'-O-phosphoglyceryl derivatives of (2'-5')oligo(adenylate)," *Eur. J. Biochem.*, 142(29):291-298 (1984).
Beaucage and Iyer, "The Functionalization of Oligonucleotides Via Phosphoramidite Derivatives," *Tetrahedron* 49:1925-1963 (1993).
Beaudry and Joyce, "Directed Evolution of an RNA Enzyme," *Science* 257:635-641 (1992).
Beigelman et al., "Chemical Modification of Hammerhead Ribozymes," *The Journal of Biological Chemistry* 270:25702-25708 (1995).
Bellon et al., "Amino-Linked Ribozymes: Post-Synthetic Conjugation of Half-Ribozymes," *Nucleosides & Nucleotides* 16:951-954 (1997).
Bellon et al., "Post-synthetically Ligated Ribozymes: An Alternative Approach to Iterative Solid Phase Synthesis," *Bioconjugate Chem.* 8:204-212 (1997).
Berkman et al., "Expression of the Vascular Permeability Factor/Vascular Endothelial Growth Factor Gene in Central Nervous System Neoplasms," The Journal of Clinical Investigation, Inc. 91:153-159 (1993).
Bernstein et al., "Role for a Bidentate Ribonuclease in the Initiation Step of RNA Interference," *Nature* 409:363-366 (2001).
Berzal-Herranz et al., "Essential nucleotide sequences and secondary structure elements of the hairpin ribozyme," *EBMO J.* 12:2567-2574 (1993).
Berzal-Herranz et al., "In vitro selection of active hairpin ribozymes by sequential RNA-catalyzed clevage and ligation reactions," *Genes & Development* 6:129-134 (1992).
Bettinger et al., "Size Reduction of Galactosylated PEI/DNA Complexes Improves Lectin-Mediated Gene Transfer into Hepatocytes," *Bioconjugate Chem.*, 10, 558-561 (1999).
Bevilacqua et al., "A Mechanistic Framework for the Second Step of Splicing Catalyzed by the *Tetrahymena* Ribozyme," *Biochemistry* 35:648-568 (1996).
Blease et al., "Emerging treatments for asthma," *Expert Opin. Emerging Drugs*, 8(1):71-81 (2003).
Boado et al., "Drug Delivery of Antisense Molecules to the Brain for Treatment of Alzheimer's Disease and Cerebral AIDS," *Journal of Pharmaceutical Sciences* 87:1308-1315 (1998).
Boado, "Antisense drug delivery through the blood-brain barrier," *Advanced Drug Delivery Reviews* 15:73-107 (1995).
Bongartz et al., "Improved biological activity of antisense oligonucleotides conjugated to a fusogenic peptide," *Nucleic Acids Research* 22:4681-4688 (1994).
Bonora et al., "Biological Properties of Antisense Oligonucleotides Conjugated to Different High-Molecular Mass Poly(ethylen glycols)," *Nucleosides & Nucleotides* 18:1723-1725 (1999).
Bonora et al., "Synthesis and Characterization of High-Molecular Mass Polyethylene Glycol-Conjugated Oligonucleotides," *Bioconjugate Chem.* 8:793-797 (1997).
Brand, "Topical and transdermal delivery of antisense oligonucleotides," *Curr. Opin. Mol. Ther.*, 3(3):244-248 (2001) [Abstract Only].
Breaker and Joyce, "Inventing and improving ribozyme function: rational design versus iterative selection methods," *Tibtech* 12:268-275 (1994).
Breaker et al., "A DNA enzyme with $Mg^2$-dependent RNA phosphoesterase activity," *Chemistry & Biology* 2(10):655-660 (1995).
Breaker, "Are engineered proteins getting competition from RNA?" *Current Opinion in Biotechnology* 7:442-448 (1996).
Breaker, "Catalytic DNA: in training and seeking employment," *Nature Biotechnology* 17:422-423 (1999).
Brennan et al., "Two-Dimensional Parallel Array Technology as a New Approach to Automated Combinatorial Solid-Phase Organic Synthesis," *Biotechnology and Bioengineering (Combinatorial Chemistry)* 61:33-45 (1998).

Broaddus et al., "Distribution and stability of antisense phosphorothioate oligonucleotides in rodent brain following direct intraparenchymal controlled-rate infusion," *Neurosurg. Focus* 3(5):Article 4 (1997).

Broaddus et al., "Distribution and stability of antisense phosphorothioate oligonucleotides in rodent brain following direct intraparenchymal controlled-rate infusion," *J Neurosurg* 88:734-742 (1998).

Brody and Gold, "Aptamers as therapeutic and diagnostic agents," *Reviews in Molecular Biotechnology* 74:5-13 (2000).

Buckwold et al., "Effects of a Naturally Occurring Mutation in the Hepatitis B Virus Basal Core Promoter on Precore Cene Expression and Viral Replication," *Journal of Virology*, 5845-5851 (1996).

Burger et al., "Experimental Corneal Neovascularization: Biomicroscopic, Angiographic, and Morphologic Correlation," *Cornea* 4:35-41 (1985/1986).

Burgin et al., "Chemically Modified Hammerhead Ribozymes with Improved Catalytic Rates," *Biochemistry* 35:14090-14097 (1996) (vol. No. mistakenly listed as 6).

Burlina et al., "Chemical Engineering of RNase Resistant and Catalytically Active Hammerhead Ribozymes," *Bioorganic & Medicinal Chemistry* 5:1999-2010 (1997).

Caplen, Nathan, "RNAi as a gene therapy approach," *Expert Opin. Biol. Ther*: 3(4):575-586 (2003).

Caruthers et al., "Chemical Synthesis of Deoxyoligonucleotides and Deoxyoligonucleotide Analogs," *Methods in Enzymology* 211:3-19 (1992).

Cebon et al., "New DNA Modification Strategies Involving Oxime Formation," *Aust. J. Chem*. 53:333-339 (2000).

Cech, "Ribozymes and Their Medical Implications," *JAMA* 260:3030-3034 (1988).

Chaloin et al., "Design of Carrier Peptide-Oligonucleotide Conjugates With Rapid Membrane Translocation and Nuclear Localization Properties," *BBRC* 243:601-608 (1998).

Chartrand et al., "An oligodeoxyribonucleotide that supports catalytic activity in the hammerhead ribozyme domain," *Nucleic Acids Research* 23(20):4092-4096 (1995).

Chen et al., "Multitarget-Ribozyme Directed to Cleave at up to Nine Highly Conserved HIV-1 env RNA Regions Inhibits HIV-1 Replication-Potential Effectiveness Against Most Presently Sequenced HIV-1 Isolates," *Nucleic Acids Research* 20:4581-4589 (1992).

Chiu et al., "siRNA function in RNAi: A chemical modification analysis," RNA, 9:1034-1048 (2003).

Choi et al., "Effect of Poly(ethylene glycol) Grafting on Polyethylenimine as a Gene Transfer Vector in vitro," *Bull. Korean Chem. Soc.*, 22, 46-52 (2001).

Chowrira et al., "In Vitro and in Vivo Comparison of Hammerhead, Hairpin, and Hepatitis Delta Virus Self-Processing Ribozyme Cassettes," *J. Biol. Chem*. 269:25856-25864 (1994).

Chowrira et al., "Novel guanosine requirement for catalysis by the hairpin ribozyme," *Nature* 354:320-322 (1991).

Chun et al., "Effect of infusion of vasoactive intestinal peptide (VIP)-antisense oligodeoxynucleotide into the third cerebral ventricle above the hypothalamic cuprachiasmatic nucleus on the hyperglycemia caused by intracranial injection of 2-deoxy-D-glucose in rats," *Neuroscience Letters* 257:135-138 (1998).

Clark and Yoria, "Ophthalmic Drug Discovery," *Nature*, 2, 448-459 (2003).

Claverie, Jean-Michael, "Fewer Genes, More Noncoding RNA," *Science*, 309, 1529-1530 (2005).

Clemens et al., "The Double-Stranded RNA-Dependent Protein Kinase PKR: Structure and Function," *Journal of Interferon and Cytokine Research*, 17:503-524 (1997).

Cload and Schepartz, "Polyether Tethered Oligonucleotide Probes," *J. Am. Chem. Soc.* 113:6324-6326 (1991).

Cole et al., "Activation of RNase L by 2',5'-Oligoadenylates," The Journal of Biological Chemistry, 272:31, 19187-19192 (1997).

Collins and Olive, "Reaction Conditions and Kinetics of Self-Cleavage of a Ribozyme Derived From *Neurospora* VS RNA," *Biochemistry* 32:2795-2799 (1993).

Connolly et al., "Binding and Endocytosis of Cluster Glycosides by Rabbit Hepatocytes," *The Journ. of Biol. Chem*. 257:939-945 (1982).

Conry et al., "Phase I Trial of a Recombinant Vaccinia Virus Encoding Carcinoembryonic Antigen in Metastatic Adenocarcinoma: Comparison of Intradermal versus Subcutaneous Administration," *Clinical Cancer Research* 5:2330-2337 (1999).

Corry et al., "Biology and Therapeutic Potential of the Interleukin-4/Interleukin-13 Signaling Pathway in Asthma," *Am. J. Respir. Med.*, 1(3):185-193 (2002).

Couture and Stinchcomb, "Anti-gene therapy: the use of ribozymes to inhibit gene function," *Trends In Genetics* 12:510-515 (1996).

Crooke, "Advances in Understanding the Pharmacological Properties of Antisense Oligonucleotides," *Advances in Pharmacology* 40:1-49 (1997).

Crooke, "Antisense Therapeutics," *Biotechnology and Genetic Engineering Reviews* 15:121-157 (1998).

Crooke, "Progress in Antisense Technology: The End of the Beginning," *Methods in Enzymology* 313:3-45 (1999).

Cullen, Bryan R., "Derivation and function of small interfering RNAs and microRNAs," *Virus Research*, 102, 3-9 (2004).

d'Aldin et al., "Antisense oligonucleotides to the GluR2 AMPA receptor subunit modify excitatory synaptic transmission in vivo," *Molecular Brain Research* 55:151-164 (1998).

Daniels et al., "Two Competing Pathways for Self-splicing by Group II Introns: A Quantitative Analysis of in Vitro Reaction Rates and Products," *J. Mol. Biol*. 256:31-49 (1996).

Defrancq and Lhomme, "Use of an Aminooxy Linker for the Functionalization of Oligodeoxyribonucleotides," *Bioorganic & Medicinal Chem. Lett*. 11:931-933 (2001).

Delihas et al., "Natural antisense RNA/target RNA interactions: Possible models for antisense oligonucleotide drug design," *Nature Biotechnology* 15:751-753 (1997).

Detmar et al., "Overexpression of Vascular Permeability Factor/Vascular Endothelial Growth Factor and its Receptors in Psoriasis," J. Exp. Med. 180:1141-1146 (1994).

Diebold et al., "Mannose Polyethylenimine Conjugates for Targeted DNA Delivery into Dendritic Cells*," *The Journal of Biological Chemistry*, 274, 19087-19094 (1999).

Dropulic et al., "Functional Characterization of a U5 Ribozyme: Intracellular Suppression of Human Immunodeficiency Virus Type I Expression," *Journal of Virology* 66:1432-1441 (1992).

Dryden et al., "The lack of specificity of neuropeptide Y (NPY) antisense oligodeoxynucleotides administered intracerebroventricularly in inhibiting food intake and NPY gene expression in the rat hypothalamus," *Journal of Endocrinology* 157:169-175 (1998).

Durand et al., "Circular Dichroism Studies of an Oligodeoxyribonucleotide Containing a Hairpin Loop Made of a Hexaethylene Glycol Chain: Conformation and Stability," *Nucleic Acids Research* 18:6353-6359 (1990) [sometimes referred to as Seela and Kaiser].

Duval-Valentin, "Specific inhibition of transcription by triple helix-forming oligonucleotides," *Proc. Natl. Acad. Sci. USA* 89:504-508 (1992).

Earnshaw et al., "Modified Oligoribonucleotides as Site-Specific Probes of RNA Structure and Function," *Biopolymers* 48:39-55 (1998).

Economides et al., Cytokine traps: multi-componetnt, high-affinity blockers of cytokine action, Nature Medicine, 9, 1, 47-52 (2003).

Edbauer et al., Resenilin and nicastrin regulate each other and determine amyloid β-peptide production via complex formation, *PNAS*, 99, 8666-8671 (2002).

Egholm et al., "PNA hybridizes to complementary oligonucleotides obeying the Watson-Crick hydrogen-bonding rules," *Nature* 365:566-568 (1993).

Elbashir et al., "Duplexes of 21-nucleotide RNAs mediate RNA interference in cultured mammalian cells," *Nature* 411:494-498 (2001).

Elbashir et al., "Functional Anatomy of siRNAs for Mediating Efficient RNAi in *Drosophila Melanogaster* Embryo Lysate," *The EMBO Journal* 20:6877-6888 (2001).

Elbashir et al., "RNA Interference is Mediated by 21- and 22-Nucleotide RNAs," *Genes and Development* 15:188-200 (2001).

Elkins and Rossi, "Ch. 2—Cellular Delivery of Ribozymes," in *Delivery Strategies for Antisense Oligonucleotide Therapeutics*, edited by Akhtar, CRC Press, pp. 17-220 (1995).

Elroy-Stein and Moss, "Cytoplasmic Expression System Based on Constitutive Synthesis of Bacteriophage T7 RNA Polymerase in Mammalian Cells," *Proc. Natl. Acad. Sci. USA* 87:6743-6747 (1990).

Emerich et al., "Biocompatability of Poly (DL-Lactide-*co*-Glycolide) Microshperes Implanted Into the Brain," *Cell Transplantation* 8:47-58 (1999).

Epa et al., "Downregulation of the p75 Neurotrophin Receptor in Tissue Culture and In Vivo, Using β-Cyclodextrin-Adamantane-Oligonucleotide Conjugates," *Antisense and Nucleic Acid Drug Dev.* 10:469-478 (2000).

Erbacher et al., Transfection and physical properties of various saccharide, poly(ethylene glycol), and antibody-derivatized polyethylenimines (PEI), *The Journal of Gene Medicine*, 1, 210-222 (1999) [sometimes incorrectly cited aas pp. 1-18].

European Supplementary Partial European Search Report for Application No. EP 03 74 2769 dated Nov. 11, 2004.

Fava et al., "Vascular Permeability Factor/Endothelial Growth Factor (VPF/VEGF): Accumulation and Expression in Human Synovial Fluids and Rheumatoid Synovial Tissue," J. Exp. Med. 180:341-346 (1994).

Feldstein et al., "Two sequences participating in the autolytic processing of satellite tobacco ringspot virus complementary RNA," *Gene* 82:53-61 (1989).

Ferentz and Verdine, "Disulfied Cross-Linked Oligonucleotides," *J. Am. Chem. Soc.* 113:4000-4002 (1991).

Filion and Phillips, "Toxicity and immunomodulatory activity of liposomal vectors formulated with cationic lipids toward immune effector cells," *Biochimica et Biophysica Acta* 1329:345-356 (1997).

Filleur et al., "SiRNA-mediated Inhibition of Vascular Endothelial Growth Factor Severely Limits Tumor Resistance to Antiangiogenic Thrombospondin-1 and Slows Tumor Vascularization and Growth," *Cancer Research*, 63, 3919-3922 (2003).

Findeis, "Stepwise Synthesis of a GalNAc-containing Cluster Glycoside Ligand of the Asialoglycoprotein Receptor," *Int. J. Peptide Protein Res.* 43:477-485 (1994).

Fire et al., "Potent and Specific Genetic Interference by Double-Stranded RNA in *Caenorhabditis elegans*," *Nature* 391:806-811 (1998).

Fire, "RNA-triggered Gene Silencing," *TIG* 15:358-363 (1999).

Folkman et al., "Long-term Culture of Capillary Endothelial Cells," Proc. Natl. Acad. Sci. USA 76:5217-5221 (1979).

Folkman, Judah, "Tumor Angiogenesis," Advances in Cancer Research 43:175-203 (1985).

Forster and Altman, "External Guide Sequences for an RNA Enzyme," *Science* 249:783-786 (1990).

Fox, "Targeting DNA with Triplexes," *Current Medicinal Chemistry* 7:17-37 (2000).

Freier et al., "Improved free-energy parameters for predictions of RNA duplex stability," *Proc. Natl. Acad. Sci. USA* 83:9373-9377 (1986) [sometimes referred to as Frier].

Furgeson et al., "Modified Linear Polyethylenimine-Cholesterol Conjugates for DNA Complexation," *Bioconjugate Chem.*, 14, 840-847 (2003).

Futami et al., "Induction of apoptosis in HeLa cells with siRNA expression vector targeted against bcl-2," Nucleic Acids Research Supplement, 251-252 (2002).

Gao and Huang, "Cytoplasmic Expression of a Reporter Gene by Co-Delivery of T7 RNA Polymerase and T7 Promoter Sequence with Cationic Liposomes," *Nucleic Acids Research* 21:2867-2872 (1993).

Ghirnikar et al., "Chemokine inhibition in rat stab would brain injury using antisense oligodeoxynucleotides," *Neuroscience Letters* 247:21-24 (1998).

Godbey et al., "Poly(ethylenimine) and its role in gene delivery," *Journal of Controlled Release*, 60, 149-160 (1999).

Godbey et al., "Tracking the intracellular path of poly(ethylenimine)/DNA complexes for gene delivery," *Proc. Natl. Acad. Sci. USA*, 96, 5177-5181 (1999).

Godwin et al., "The Synthesis of Biologically Active Pteroyloligo-γ-$_L$-Glutamates (Folic Acid Conjugates)," *The Journal of Biological Chemistry* 247:2266-2271 (1972).

Gold et al., "Diversity of Oligonucleotide Functions," *Annu. Rev. Biochem.* 64:763-797 (1995).

Gold, "Axonal Regeneration of Sensory Nerves is Delayed by Continuous Intrathecal Infusion of Nerve Growth Factor," *Neuroscience* 76:1153-1158 (1997).

Gonzalez et al., "New Class of Polymers for the Delivery of Macromolecular Therapeutics," *Bioconjugates Chem.*, 10, 1068-1074 (1999).

Good et al., "Expression of small, therapuetic RNAs in human nuclei," *Gene Therapy* 4:45-54 (1997).

Grant et al., "Insulin-like growth factor I acts as an angiogenic agent in rabbit cornea and retina: comparative studies with basic fibroblast growth factor," *Diabetologia* 36:282-291 (1993).

Grasby et al., "Purine Functional Groups in Essential Residues of the Hairpin Ribozyme Required for Catalytic Cleavage of RNA," *Biochemistry* 34:4068-4076 (1995).

Griffin et al., "Group II intron ribozymes that cleave DNA and RNA linkages with similar efficiency, and lack contacts with substrate 2'-hydroxyl groups," *Chemistry & Biology* 2:761-770 (1995).

Guerrier-Takada et al., "The RNA Moiety of Ribonuclease P Is the Catalytic Subunit of the Enzyme," *Cell* 35:849-857 (1983).

Guo and Collins, "Efficent *trans*-cleavage of a stem-loop RNA substrate by a ribozyme derived from *Neurospora* VS RNA," *EMBO J.* 14:368-376 (1995).

Habus et al., "A Mild and Efficient Solid-Support Synthesis of Novel Oligonucleotide Conjugates," *Bioconjugate Chem.* 9:283-291 (1998).

Hall et al., "Establishment and Maintenance of a Heterochromatin Domain," *Science* 297:2232-2237 (2002).

Hall, "Interleukin-4 receptor α gene variants and allergic disease," *Respir. Res.*, 1, 1:6-8 (2000).

Hamilton, et al., "A Species of Small Antisense RNA Posttranscriptional Gene Silencing in Plants," *Science*, 286, 950-952 (1999)).

Hammann et al., "Length Variation of Helix III in a Hammerhead Ribozyme and Its Influence on Cleavage Activity," *Antisense & Nucleic Acid Drug Development* 9:25-31 (1999).

Hammond et al., "An RNA-Directed Nuclease Mediates Post-Transcriptional Gene Silencing in *Drosophila* Cells," *Nature* 404:293-296 (2000).

Hammond, et al., "Post-transcriptional Gene Silencing by Double-Stranded RNA," *Nature Reviews*, 2:110-119 (2001).

Hampel and Tritz, "RNA Catalytic Properties of the Minimum (-)sTRSV Sequence," *Biochemistry* 28:4929-4933 (1989).

Hampel et al., "'Hairpin' Catalytic RNA Model: Evidence for Helices and Sequence Requirement for Substrate RNA," *Nucleic Acids Research* 18:299-304 (1990).

Haniu et al., "Characterization of Alzheimer's β-Secretase Protein BACE," *The Journal of Biological Chemistry*, 275, 21099-21106 (2000).

Harborth et al., "Sequence, Chemical, and Structural Variation of Small Interfering RNAs and Short Hairpin RNAs and the Effect on Mammalian Gene Silencing," Antisense and Nucleic Acid Drug Development, 13:83-105 (2003).

Harris et al., "Indentification of phosphates involved in catalysis by the ribozyme RNase P RNA," *RNA* 1:210-218 (1995).

Hartmann et al., "Spontaneous and Cationic Lipid-Mediated Uptake of Antisense Oligonucleotides in Human Monocytes and Lymphocytes," *The Journal of Pharmacology and Experimental Therapeutics* 285:920-928 (1998).

Haseloff and Gerlach, "Sequences required for self-catalysed cleavage of the satellite RNA of tobacco ringspot virus," *Gene* 82:43-52 (1989).

He et al., "MicroRNAs: Small RNAs with a Big Role in Gene Regulation," *Nat. Rev. Genet.*, 5, 522-531 (2004).

Hegg et al., "Kinetics and Thermodynamics of Intermolecular Catalysis by Hairpin Ribozymes," *Biochemistry* 34:15813-15828 (1995).

Hermann and Patel, "Adaptive Recognition by Nucleic Acid Aptamers," *Science* 287:820-825 (2000).

Herrmann et al., "Comparative analysis of adenoviral transgene delivery via tail or portal vein into rat liver," Arch Virol 149:1611-1617 (2004).

Herschlag and Cech, "Catalysis of RNA Cleavage by the *Tetrahymena thermophila* Ribozyme 1. Kinetic Description of the Reaction of an RNA Substrate Complementary to the Active Site," *Biochemistry* 29:10159-10171 (1990).

Herschlag and Cech, "Catalysis of RNA Cleavage by the *Tetrahymena thermophila* Ribozyme. 2. Kinetic Description of the Reaction of an RNA Substrate That Forms a Mismatch at the Active Site," *Biochemistry* 29:10172-10180 (1990).

Hertel et al., "A Kinetic Thermodynamic Framework for the Hammerhead Ribozyme Reaction," *Biochemistry* 33:3374-3385 (1994).

Hertel et al., "Numbering System for the Hammerhead," *Nucleic Acids Research* 20:3252 (1992).

Hofland and Huang, "Formulation and Delivery of Nucleic Acids," *Handbook of Exp. Pharmacol.* 137:165-192 (1999).

Hong et al., "pH-sensitive, serum-stable and long-circulating liposomes as a new drug delivery system," Journal of Pharmacy and Pharmacology, 54:51-58 (2002).

Hornung et al., "Sequence-specific potent induction of IFN-α by short interfering RNA in plasmacytoid dendritic cells through TLR7," *Nature Medicine*, 11, 263-270 (2005).

Hudson et al., "Cellular Delivery of Hammerhead Ribozymes Conjugated to a Transferrin Receptor Antibody," *Int'l Jour. of Pharmaceutics* 182:49-58 (1999).

Hunziker et al., "Nucleic Acid Analogues: Synthesis and Properties, in Modern Synthetic Methods," *VCH*, 331-417.

Hussain et al., "Identification of a Novel Aspartic Protease (Asp 2) as β-Secretase," *Molecular and Cellular Neuroscience*, 14, 419-427 (1999).

Hutvagner and Zamore, "A MicroRNA in a Multiple-Turnover RNAi Enzyme Complex," *Science* 297:2056-2060 (2002).

Hutvagner et al., "A Cellular Function for the RNA-Interference Enzyme Dicer in the Maturation of the *let*-7 Small Temporal RNA," *Science* 293:834-838 (2001).

International Search Report for PCT/US03/04710 mailed Nov. 18, 2003.

International Search Report for PCT/US03/05022 mailed Jan. 6, 2005.

International Search Report for PCT/US03/05028 mailed Oct. 17, 2003.

International Search Report for PCT/US03/05346 mailed Oct. 17, 2003.

International Search Report for PCT/US03/18911 mailed Nov. 19, 2003.

International Search Report for PCT/US2004/016390 mailed Mar. 31, 2005.

International Search Report for PCT/US2004/027403 mailed Jul. 12, 2005.

International Search Report for PCT/US2004/030488 mailed Jan. 12, 2005.

International Search Report for PCT/US2005/043510 mailed Sep. 7, 2006.

Ishiwata et al., "Physical-Chemistry Characteristics and Biodistribution of Poly(ethylene glycol)-Coated Liposomes Using Poly(oxyethylene) Cholesteryl Ether," *Chem. Pharm. Bull.* 43:1005-1011 (1995) (mistakenly referred to as Ishiwataet).

Ishizaka et al., "Isolation of Active Ribozymes from an RNA Pool of Random Sequences Using an Anchored Substrate RNA," *Biochemical and Biophysical Research Communication* 214(2):403-409 (1995).

Izant and Weintraub, "Constitutive and Conditional Suppression of Exogenous and Endogeneous Genes by Anti-Sense RNA," *Science* 229:345-352 (1985).

Jackson et al., "Chemical perfusion of the inner ear," *Otolarynjol. Clin. N. Am.*, 35:639-653 (2002).

Janowski et al, "Inhibiting gene expression at transcription start sites in chromosomal DNA with antigene RNAs", *Nature Chemical Biology*, 1, 216-222 (2005).

Jarvis et al., "Optimizing the Cell Efficacy of Synthetic Ribozymes," *Journal of Biological Chemistry* 271:29107-29112 (1996).

Jaschke et al., "Automated Incorporation of Polyethylene Glycol into Synthetic Oligonucleotides," *Tetrahedron Letters* 34:301-304 (1993) (sometimes mistakenly referred to as Jschke).

Jaschke et al., "Synthesis and Properties of Oligodeoxyribonuclotide-polyethylene Glycol Conjugates," *Nucleic Acids Research* 22:4810-4817 (1994).

Jaschke, "Oligonucleotide-Poly(ethylene glycol) Conjugates: Synthesis, Properties, and Application," *American Chemical Society* 680:265-283 (1997).

Jayasena, "Aptamers: An Emerging Class of Molecules that Rival Antibodies in Diagnostics," *Clinical Chemistry* 45:1628-1650 (1999).

Jen et al., "Suppression of gene Expression by Targeted Disruption of Messenger RNA: Available Options and Current Strategies," Stem Cells, 18:307-319 (2000).

Jenuwein, "An RNA-Guided Pathway for the Epigenome," *Science* 297:2215-2218 (2002).

Jolliet-Riant and Tillement, "Drug transfer across the blood-brain barrier and improvement of brain delivery," *Fundam. Clin. Pharmacol.* 13:16-26 (1999).

Joseph et al., "Substrate selection rules for the hairpin ribozyme determined by in vitro selection, mutation, and analysis of mismatched substrates," *Genes & Development* 7:130-138 (1993).

Joyce et al., "Amplification, mutation and selection of catalytic RNA," *Gene* 82:83-87 (1989).

Joyce, "Directed Molecular Evolution," *Scientific American* 267:90-97 (1992).

Judge et al., "Sequence-dependent stimulation of the mammalian innate immune response by synthetic siRNA," *Nature Biotechnology*, 23(4):457-462 (2005).

Kanikkannan, Iontophoresis-Based Transdermal Delivery *Systems, Biodrugs*, 16(5):339-347 (2002).

Karle et al., "Differential Changes in Induced Seizures After Hippocampal Treatment of Rats with an Antisense Oligodeoxynucleotide to the GABA$_A$ Receptor $_\gamma$2 Subunit," *Euro. Jour. of Pharmacology* 340:153-160 (1997).

Karpeisky et al, "Highly Efficient Synthesis of 2'-O-Amino Nucleosides And Their Incorporation in Hammerhead Ribozymes," *Tetrahedron Letters* 39:1131-1134 (1998).

Kashani-Sabet et al., "Reversal of the Malignant Phenotype by an Anti-*ras* Ribozyme," *Antisense Research & Development* 2:3-15 (1992).

Kaspareit-Rittinghausen et al., "Animal Model of Human Disease: Hereditary Polycystic Kidney Disease," Amer. Journ. of Pathology 139:693-696 (1991).

Keen, Leigh J., "The Study of Polymorphism in Cytokine and Cytokine Receptor Genes," *ASHI Quarterly*, 152, 4th Quarter 2002.

Kim et al., "Inhibition of vascular endothelial growth factor-induced angiogenesis suppresses tumour growth in vivo," *Nature* 362:841-844 (1993).

King et al., "Cytokine and Chemokine Expression Kinetics After Corneal Transplantation," *Transplanation*, 70, 8, 1225-1233 (2000).

Knitt et al., "ph Dependencies of the *Tetrahymena* Ribozyme Reveal an Unconvential Origin of an Apparent p$K_a$," *Biochemistry* 35:1560-1570 (1996).

Koch et al., "Vascular Endothelial Growth Factor," *Journal of Immunology*, 152:4149-4156 (1994).

Koike et al., "Thimet Oligopeptidase Cleaves the Full-Length Alzheimer Amyloid Precursor Protein at a β-Secretase Cleavage Site in COS Cells," *J. Biochem.*, 126, 235-242 (1999).

Kore, et al., "Sequence specificity of the hammerhead ribozyme revisistsed; the NIH rule," *Nucleic Acids Research*, 26(18):4116-4120 (1998).

Kou et al., "Differential Regulation of Vascular Endothelial Growth Factor Receptors (VEGRF) Revealed by RNA Interference: Interactions of VEGFR-1 and VEGFR-2 in Endothelial Cell Signaling," *Biochemistry*, 44:15064-15073 (2005).

Kronenwett et al., "Oligodeoxyribonucleotide Uptake in Primary Human Hematopoietic Cells is Enhanced by Cationic Lipids and Depends on the Hematopoietic Cell Subset," *Blood* 91:852-862 (1998).

Kumar and Ellington, "Artificial evolution and natural ribozymes," *FASEB J.* 9:1183-1195 (1995).

Kunath et al., "The structure of PEG-modified poly(ethylene imines) influences biodistribution and pharmacokinetics of their complexes with NF-kappaB decoy in mice.," Medline (Pharm Res.) 19(6): 810-817 (Jun. 1, 2002).

Kuperman et al., "Direct effects of interleukin-13 on epithelial cells cause airway hyperreactivity and mucus overproduction in asthma," Nature Medicine, 8, 8, 885-889 (2002).

Kusser, "Chemically modified nucleic acid aptamers for in vitro selections: evolving evolution," Reviews in Molecular Biotechnology 74:27-38 (2000).

Kuwabara et al., "A C. elegans patched gene, ptc-1, functions in germ-line cytokinesis," Genes and Development, 14(15):1933-1944 (2000).

Kuwabara et al., "Allosterically Controllable Ribozymes with Biosensor Functions," Current Opinion in Chem. Biol. 4:669-677 (2000).

Kwak et al., "VEGF Is Major Stimulator in Model of Choroidal Neovascularization," Investigative Ophthalmology & Visual Science, 41(10), 3158-3164 (2000).

Lasic and Needham "The 'Stealth' Liposome: A Prototypical Biomaterial," Chemical Reviews 95:2601-2627 (1995).

Lasic and Papahadjopoulos, "Liposomes Revisited," Science 267:1275-1276 (1995).

Lee and Larson, "Modified Liposome Formulations for Cytosolic Delivery of Macromolecules," ACS Symposium Series 752:184-192 (2000).

Lee and Lee, "Preparation of Cluster Glycosides of N-Acetylgalactosamine That Have Subnanomolar Binding Constants Towards the Mammalian Hepatic Gal/GalNAc-specific Receptor," Glyconjugates J. 4:317-328 (1987).

Lee et al., "Enhancing the Catalytic Repertoire of Nucleic Acids: A Systematic Study of Linker Length and Rigidity," Nucleic Acids Research 29:1565-1573 (2001).

Lee et al., "Expression of Small Interfering RNA's Targeted Against HIV-1 rev Transcripts in Human Cells," Nature Biotechnology 19:500-505 (2002).

Lee et al., "Vascular endothelial growth factor (VEGF) induces remodeling and enhances TH2-mediated sensitization and inflammation in the lung," Nature Medicine, 10, 1095-1103 (2004).

Leifer et al., "Heterogeneity in the Human Response to Immunostimulatory CpG Oligodeoxynucleotides," Journal of Immunotherapy, 26(4):313-319 (2003).

Leirdal et al., "Gene silencing in mammalian cells by preformed small RNA duplexes," Biochemical and Biophysical Research Communications, 295, 744-748 (2002).

Lendlein et al., "Biodegradable, Elastic Shape-Memory Polymers for Potential Biomedical Applications," Science, 296, 1673-1676 (2002).

Lepri et al., "Effect of Low Molecular Weight Heparan Sulphate on Angiogenesis in the Rat Cornea after Chemical Cauterization," Journal of Ocular Pharmacology 10:273-281 (1994).

L'Huillier et al., "Cytoplasmic Delivery of Ribozymes Leads to Efficient Reduction in α-Lactalbumin mRNA Levels in C1271 Mouse," EMBO J. 11:4411-4418 (1992).

Li and Altman, "Cleavage by RNase P of gene N mRNA reduces bacteriophage γ burst size," Nucleic Acids Research 24:835-842 (1996).

Li et al., "Thermodynamic and Activation Parameters for Binding of a Pyrene-Labeled Substrate by the Tetrahymena Ribozyme: Docking is Not Diffusion-Controlled and is Driven by a Favorable Entropy Change," Biochemistry 34:14394-14399 (1995).

Lichner et al., "Double-stranded RNA-binding proteins could suppress RNA interference-mediated antiviral defences," Journal of General Virology, 84, 975-980 (2003).

Lieber et al., "Stable High-Level Gene Expression in Mammalian Cells by T7 Phage RNA Polymerase," Methods Enzymol. 217:47-66 (1993).

Limbach et al., "Summary: the modified nucleosides of RNA," Nucleic Acids Research 22(12):2183-2196 (1994).

Lin and Matteucci, "A Cytosine Analogue Capable of Clamp-Like Binding to a Guanine in Helical Nucleic Acid," J. Am. Chem. Soc. 120:8531-8532 (1998).

Lin et al., "A Novel mRNA-cRNA Interference Phenomenon for Silencing bcl-2 Expression in Human LNCaP Cells," Biochemical and Biophysical Research Communications, 281, 639-644 (2001).

Lin et al., "Human aspartic protease memapsin 2 cleaves the β-secretase siet of β-amyloid precursor protein," PNAS, 97, 1456-1460 (2000).

Lin et al., "Policing rogue genes," Nature, 402, 128-129 (1999).

Lin et al., "Relation of an Interleukin-10 Promoter Polymorphism to Graft-versus-Host Disease and Survival after Hematopoietic-Cell Transplantation," The New England Journal of Medicine, 349:2201-2210 (2003).

Lindgren et al., "Translocation Properties of Novel Cell Penetrating Transportan and Penetratin Analogues," Bioconjugate Chem. 11:619-626 (2000).

Lisacek et al., "Automatic Identification of Group I Intron Cores in Genomic DNA Sequences," J. Mol. Biol. 253:1206-1217 (1994).

Lisziewicz et al., "Inhibition of Human Immunodeficiency Virus Type 1 Replication by Regulated Expression of a Polymeric Tat Activation Response RNA Decoy as a Strategy for Gene Therapy in AIDS," Proc. Natl. Acad. Sci. U.S.A. 90:8000-8004 (1993).

Liu et al., "Cationic Liposome-mediated Intravenous Gene Delivery," J. Biol. Chem. 270(42):24864-24870 (1995).

Liu et al., "Hydrodynamics-based transfection in animals by systemic administration of plasmid DNA," Gene Therapy, 6, 1258-1266 (1999).

Liu et al., "Poly(cationic lipid)-mediated in vivo gene delivery to mouse liver," Gene Therapy, 10:180-187 (2003).

Loakes, "The Applications of Universal DNA Base Analogues," Nucleic Acids Research 29:2437-2447 (2001).

Long and Uhlenbeck, "Kinetic characterization of intramolecular and intermolecular hammerhead RNAs with stem II deletions," Proc. Natl. Acad. Sci. USA 91:6977-6981 (1994).

Lu et al., "Tumor Inhibition By RNAi-Mediated VEGF an VEGFR2 Down Regulation in Xenograft Models," Cancer Gene Therapy, 10, Suppl. 1, S4-S5 (2003).

Ma and Wei, "Enhanced Delivery of Synthetic Oligonucleotides to Human Leukaemic Cells by Liposomes and Immunoliposomes," Leukemia Research 20:925-930 (1996).

Ma et al., "Design and Synthesis of RNA Miniduplexes via a Synthetic Linker Approach," Biochemistry 32:1751-1758 (1993).

Ma et al., "Design and Synthesis of RNA Miniduplexes via a Synthetic Linker Approach. 2. Generation of Covalently Closed, Double-Stranded Cyclic HIV-1 TAR RNA Analogs with High Tat-Binding Affinity," Nucleic Acids Research 21:2585-2589 (1993).

Ma et al., "Design and Synthesis of RNA Miniduplexes via a Synthetic Linker Approach," Biochemistry 32:1751-1758 (1993).

Mahato et al., "Modulation of gene expression by antisense and antigene oligodeoxynucleotides and small interfering RNA," Expert Opin. Drug Deliv., 2(1):3-28 (2005).

Maher et al., "Kinetic Analysis of Oligodeoxyribonucleotide-Directed Triple-Helix Formation on DNA," Biochemistry 29:8820-8826 (1990).

Martinez et al., "Single-Stranded Antisense siRNAs Guide Target RNA Cleavage in RNAi," Cell 110:563-574 (2002).

Matranga et al., "Passenger-Strnd Cleavage Facilitates Assembly of siRNA into Ago2-Containing RNAi Enzyme Complexes," Cell, 123:1-114 (2005).

Matsuno et al., "Hepatocyte growth factor gene transfer into the liver via the portal vein using electroporation attenuates rat liver cirrhosis," Gene Therapy, 10:1559-1566 (2003).

Mattick, John S., "The Functional Genomics of Noncoding RNA", Science, 309, 1527-1528 (2005).

Matulic-Adamic et al., "Functionalized Nucleoside 5'-triphosphates for In Vitro Selection of New Catalytic Ribonucleic Acids," Bioorganic & Medicinal Chemistry Letters 10:1299-1302 (2000).

Maurer et al., "Lipid-based systems for the intracellular delivery of genetic drugs," Molecular Membrane Biology 16:129-140 (1999).

McCurdy et al., "Deoxyoligonucleotides with Inverted Polarity: Synthesis and Use in Triple-Helix Formation" Nucleosides & Nucleotides 10:287-290 (1991).

McGarry and Lindquist, "Inhibition of heat shock protein synthesis by heat-inducible antisense RNA," Proc. Natl. Acad. Sci. USA 83:399-403 (1986).

McKay, "Structure and function of the hammerhead ribozyme: an unfinished story," RNA 2:395-403 (1996).

McLaren et al., "Vascular Endothelial Growth Factor (VEGF) Concentrations are Elevated in Peritoneal Fluid of Women with Endometriosis," Human Reproduction 11:220-223 (1996).

McLaren et al., "Vascular Endothelial Growth Factor is Produced by Peritoneal Fluid Macrophages in Endometriosis and Is Regulated by Ovarian Steroids," J. Clin. Invest. 98:482-489 (1996).

McManus et al., "Gene Silencing Using Micro-RNA Designed Hairpins," RNA 8:842-850 (2002).

Mesmaeker et al, "Novel Backbone Replacements for Oligonucleotides," American Chemical Society, pp. 24-39 (1994).

Michel and Westhof, "Slippery substratrates," Nat. Struct. Biol. 1:5-7 (1994).

Michel et al., "Structure and Activities of Group II Introns," Annu. Rev. Biochem. 64:435-461 (1995).

Michel and Pyle, "Conversion of a Group II Intron into a New Multiple-Turnover Ribozyme that Selectively Cleaves Oligonucleotides: Elucidation of Reaction Mechanism and Structure/Function Relationships," Biochemistry 34:2965-2977 (1995).

Millauer et al., "Glioblastoma growth inhibited in vivo by a dominant-negative Flk-1 mutant," Letters to Nature 367:576-579 (1994).

Miller et al., "Vascular Endothelial Growth Factor/Vascular Permeability Factor is Temporally and Spatially Correlated with Ocular Angiogenesis in a Primate Model," American Journal of Pathology 145:574-584 (1994).

Milner et al., "Selecting effective antisense reagents on combinatorial oligonucleotide arrays," Nature Biotechnology 15:537-541 (1997).

Miyagishi and Taira, "U6 Promoter-driven siRNAs with Four Uridine 3' Overhangs Efficiently Suppress Targeted Gene Expression in Mammalian Cells," Nature Biotechnology 19:497-500 (2002).

Mohr et al., "A tyrosyl-tRNA synthetase can function similarly to an RNA structure in the Tetrahymena ribozyme," Nature 370:147-150 (1994).

Moore and Sharp, "Site-Specific Modification of Pre-mRNA: The 2'-Hydroxyl Groups at the Splice Sites," Science 256:992-996 (1992).

Mori et al., "Inhibition of Chorodial Neovascularization by Intravenous Injection of Adenoviral Vectors Expressing Secretable Endostatin," American Journal of Pathology, 159(1), 313-320 (2001).

Mori et al., "Pigment epithelium-derived factor inhibits retinal and choroidal neovascularization," Journal of Cellular Physiology, 118(2) 253-263 (2001).

Morris et al., "A New Peptide Vector for Efficient Delivery of Oligonucleotides into Mammalian Cells," Nucleic Acids Research 25:2730-2736 (1997).

Murao et al., "Targeting Efficiency of Galactosylated Liposomes to Hepatocytes in Vivo: Effect of Lipid Composition," Pharmaceutical Research, 19(12):1808-1814 (2002).

Nakamaye and Eckstein, "AUA-Cleaving Hammerhead Ribozymes: Attempted Selection for Improved Cleavage," Biochemistry 33:1271-1277 (1994).

Nathans and Smith, "Restriction Endonucleases in the Analysis and Restructuring of DNA Molecules," Ann. Rev. Biochem. 44:273-293 (1975).

Nomura et al., "Development of an Efficient Intermediate, α-[2-(Trimethylsilyl) ethoxy]-2-N-[2-trimethylsilyl)ethoxycarbonyl]folic Acid, for the Synthesis of Folate (γ)-Conjugates, and Its Application to the Synthesis of Folate-Nucleoside Conjugates," J. Org. Chem. 65:5016-5021 (2000).

Noonberg et al., In vivo generation of highly abundant sequence-specific oligonucleotides for antisense and triplex gene regulation, Nucleic Acids Research 22(14):2830-2836 (1994).

Norrby, "Angiogenesis: new aspects relating to its initiation and control," APMIA 105:417-437 (1997).

Noviello et al., "Autosomal Recessive Hypercholesterolemia Protein Interacts with and Regulates the Cell Surface Level of Alzheimer's Amyloid β Precursor Protein*," The Journal of Biological Chemistry, 278, 31843-31847 (2003).

Novina et al., "siRNA-Directed Inhibition of HIV-1 Infection," Nature Medicine 8:7, 681-686 (2002).

Nykanen et al., "ATP Requirements and Small Interfering RNA Structure in the RNA Interference Pathway," Cell 107:309-321 (2001).

O'Byrne et al., "Airway Hyperresponsiveness," Chest, 123, 3 (Supplement) 411S-416S (2003).

Ober et al., "Variation in the Inerleukin 3-Receptor α Gene Confers Susceptibility to Asthma and Atopy in Ethnically Diverse Populations," Am. J. Hum. Genet., 66:517-526 (2000).

Ohkawa et al., "Activities of HIV-RNA Targeted Ribozymes Transcribed From a 'Shot-Gun' Type Ribozyme-trimming Plasmid," Nucleic Acids Symp. Ser. 27:15-16 (1992).

Ohno-Matsui et al., "Inducible Expression of Vascular Endothelial Growth Factor in Adult Mice Causes Severe Proliferative Retinopathy and Retinal Detachment," Am. J. Pathology, 160, 711-719 (2002).

Ojwang et al., "Inhibition of Human Immunodeficiency Virus Type 1 Expression by a Hairpin Ribozyme," Proc. Natl. Acad. Sci. USA 89:10802-10806 (1992).

Oku et al., "Real-time analysis of liposomal trafficking in tumor-bearing mice by use of positron emission tomography," Biochimica et Biophysica Acta 1238:86-90 (1995).

Ono et al., "DNA Triplex Formation of Oligonucleotide Analogues Consisting of Linker Groups and Octamer Segments That Have Opposite Sugar-Phosphate Backbone Polarities," Biochemistry 30:9914-9921 (1991).

O'Reilly et al., "Angiostatin: A Novel Angiogenesis Inhibitor That Mediates the Suppression of Metastases by a Lewis Lung Carcinoma," Cell 79:315-328 (1994).

Orgis et al., "DNA/polyethylenimine transfection particles: Influence of ligands, polymer size, and PEGylation on internalization and gene expression," AAPS PharmSci., 3 (3) article 21 (http://www.pharmsci.org) p. 1-11 (2001).

Ormerod et al., "Effects of Altering the Eicosanoid Precursor Pool on Neovascularization and Inflammation in the Alkali-burned Rabbit Cornea," American Journal of Pathology 137:1243-1253 (1990).

Pal-Bhadra et al., "Heterochromatic Silencing and HP1 Localizatin in Drosophila Are Dependent on the RNAi Machinery," Science, 303, 669-672 (2004).

Pan et al., "Probing of tertiary interactions in RNA: 2'-Hydroxyl-base contacts between the Rnase P and pre-tRNA," Proc. Natl. Acad. Sci. USA 92:12510-12514 (1995).

Pandey et al., "Role ov B61, the Ligand for the Eck Receptor Tyrosine Kinase, in TNF-α-Induced Angiogenesis," Science 268:567-569 (1995).

Pardridge et al., "Vector-mediated delivery of a polyamide ("peptide") nucleic acid analogue through the blood-brain barrier in vivo," Proc. Natl. Acad. Sci. USA 92:5592-5596 (1995).

Parrish, "Functional Anatomy of a dsRNA Trigger: Differential Requirement for the Two Trigger Strands in RNA Interference," Molecular Cell 6:1077-1087 (2000).

Parry et al. 1999. "Bioactivity of anti-angiogenic ribozymes targeting Flt-1 and KDR mRNA," Nucleic Acid Res. 27:2569-77.

Passaniti et al., "A Simple, Quantitative Method for Assessing Angiogenesis and Antiangiogenic Agents Using Reconstituted Basement Membrane, Heparin and Fibroblast Growth Factor," Laboratory Investigation 67:519-528 (1992).

Paul et al., "Effective Expression of Small Interfering RNA in Human Cells," Nature Biotechnology 20:505-508 (2002).

Perreault et al., "Mixed Deoxyribo- and Ribo-Oligonucleotides with Catalytic Activity," Nature 344:565-567 (1990) (often mistakenly listed as Perrault).

Perrotta and Been, "A pseudoknot-like structure required for efficeint self-cleavage of hepatitis delta virus RNA," Nature 350:434-436 (1991).

Perrotta and Been, "Cleavage of Oligoribonucleotides by a Ribozyme Derived from the Hepatitis δ Virus RNA Sequence," Biochemistry 31:16-21 (1992).

Petersen et al., Polyethylenimine-graft-Poly(ethylene glycol) Copolymers: Influence of Copolymer Block Structure on DNA Complexation and Biological Activities as Gene Delivery System, Bioconjugate Chem., 13, 845-854 (2002).

Pieken et al., "Kinetic Characterization of Ribonuclease-Resistant 2'-Modified Hammerhead Ribozymes," Science 253:314-317 (1991).

Pierce et al., "Vascular endothelial growth factor/vascular permeability factor expression in a mouse model of retinal neovascularization," Proc. Natl. Acad. Sci. USA 92:905-909 (1995).

Plate, "Vascular endothelial growth factor is potential tumor angiogenesis factor in human gilomas in vivo," Nature 359:845-848 (1992).

Player and Torrence, "The 2-5A System: Modulation of Viral and Cellular Processes Through Acceleration of RNA Degradation," Pharmacol Ther. 78:55-113 (1998).

Ponpipom et al., "Cell-Specific Ligands for Selective Drug Delivery to Tissues and Organs," J. Med. Chem. 24:1388-1395 (1981).

Praseuth et al., "Triple helix formation and the antigene for sequence-specific control of gene expression," Biochimica et Biophysica Acta 1489:181-206 (1999).

Preat et al., "Topical delivery of nucleic acids in skin," S.T.P. Pharma Sciences, 11(1) 57-68 (2001).

Puttaraju et al., "A circular trans-acting hepatitis delta virus ribozyme," Nucleic Acids Research 21:4253-4258 (1993).

Pyle et al., "Building a Kinetic Framework for Group II Intron Ribozyme Activity: Quantitation of Interdomain Binding and Reaction Rate," Biochemistry 33:2716-2725 (1994).

Rajakumar et al., "Effects of Intrastriatal Infusion of D2 Receptor Antisense Oligonucleotide on Apomorphine-Induced Behavior in the Rat," Synapse 26:199-208 (1997).

Rand et al., Argonaute2 Cleaves the Anti-Guide Strand of siRNA during RISC Activation, Cell, 123:621-629 (2005).

Randall et al., "Clearance of replicating hepatitis C virus replicon RNAs in cell culture by small interfering RNAs," PNAS, 100, 235-240 (2003).

Ray et al., "Common Signaling Themes," Science, 306, 1505 (2004).

Regnier et al., "Parameters Controlling Topical Delivery of Oligonucleotides by Electroporation," Journal of Drug Targeting, 5(4), 275-289 (1998).

Reich et al., "Small Interfering RNA (siRNA) targeting VEGF effectively inhibits ocular neovascularization in a mouse model," Molecular Vision, 9, 210-216 (2003).

Reinhart and Bartel, "Small RNAs Correspond to Centromer Heterochromatic Repeats," Science 297:1831 (2002).

Reinhart et al., "MicroRNAs in Plants," Genes & Development 16:1616-1626 (2002).

Reynolds et al., "Rational siRNA designe for RNA interference," Nature Biotechnology, 22, 3, 326-330 (2004).

Richardson and Schepartz, "Tethered Oligonucleotide Probes. A Strategy for the Recognition of Structured RNA," J. Am. Chem. Soc. 113:5109-5111 (1991).

Robertson et al., "Purification and Properties of a Specific *Escherichia coli* Riobnuclease which Cleaves a Tyrosine Transfer Ribonucleic Acid Precursor," J. Biol. Chem. 247:5243-5251 (1972).

Rossi et al., "Ribozymes as Anti-HIV-1 Therapeutic Agents: Principles, Applications, and Problems," Aids Research and Human Retroviruses 8:183-189 (1992).

Ruoslahti, "RGD and Other Recognition Sequences for Integrins," Annu. Rev. Cell Dev. Biol. 12:697-715 (1996).

Saenger (ed), "Modified Nucleosides and Nucleotides; Nucleoside Di- and Triphosphates; Coenzymes and Antibiotics, (ch.7)" Principles of Nucleic Acid Structure 158-200 (1984).

Salo et al., "Aminooxy Functionalized Oligonucleotides: Preparation, On-Support Derivatization, and Postsynthetic Attachment to Polymer Support," Bioconjugate Chem. 10:815-823 (1999).

Sanghvi et al., "Improved Process for the Preparation of Nucleosidic Phosphoramidites Using a Safer and Cheaper Activator," Organic Process Res. & Dev. 4:175-181 (2000).

Santoro and Joyce, "A general purpose RNA-cleaving DNA enzyme," Proc. Natl. Acad. Sci. USA 94:4262-4266 (1997).

Santoro et al., "Mechanism and Utility of an RNA-Cleaving DNA Enzyme," Biochemistry 37:13330-13342 (1998).

Santoro et al., "RNA Cleavage by a DNA Enzyme with Extended Chemical Functionality," J. Am. Chem. Soc. 122:2433-2439 (2000).

Sarver et al., "Ribozymes as Potential Anti-HIV-1 Therapeutic Agents" Science 247:1222-1225 (1990).

Saville and Collins, "A Site-Specific Self-Cleavage Reaction Performed by a Novel RNA In Neurospora Mitochondria," Cell 61:685-696 (1990).

Saville and Collins, "RNA-Mediated Ligation of Self-Cleavage Products of a Neurospora Mitochondrial Plasmid Transcript," Proc. Natl. Acad. Sci. USA 88:8826-8830 (1991).

Scanlon et al., "Ribozyme-Mediated Cleavage of c-fos mRNA Reduces Gene Expression of DNA Synthesis Enzymes and Metallothionein," Proc. Natl. Acad. Sci. USA 88:10591-10595 (1991).

Scaringe et al., "Chemical synthesis of biologically active oligoribonucleotides using β-cyanoethyl protected ribonucleoside phosphoramidites," Nucl Acids Res. 18:5433-5441 (1990).

Scherer et al., "Approaches for the sequence-specific knockdown of mRNA," Nature Biotechnology, 21;12, 1457-1465 (2003).

Schmajuk et al., "Antisense Oligonucleotides with Different Backbones," The Journal of Biological Chemistry 274:21783-21789 (1999).

Schmidt et al., "Base and sugar requirements for RNA cleavage of essential nucleoside residues in internal loop B of the hairpin ribozyme: implications for secondary structure," Nucleic Acids Research 24:573-581 (1996).

Schroeder et al., "Diffusion Enhancement of Drugs by Loaded Nanoparticles in Vitro," Prog. Neuro-Psychopharmacol. & Biol. Psychiat. 23:941-949 (1999) [sometimes cited by RPI as Prog Neuropsychopharmacol Biol Psychiatry 23:941-949, 1999].

Schwartz et al., "Evidence that siRNAs Function as Guides, Not Primers, in the Drosophila and Human RNAi Pathways," Molecular Cell 10:537-548 (2002).

Schwartz et al., "Asymmetry in the Assembly of the RNAi Enzyme Complex," Cell, 1115, 199-208 (2003).

Schwarze et al., "In Vivo Protein Transduction: Delivery of a Biologically Active Protein into the Mouse," Science 285:1569-1572 (1999).

Scott et al., "The crystal structure of an All-RNA hammerhead ribozyme: A proposed mechanism for RNA catalytic cleavage," Cell 81:991-1002 (1995).

Seela and Kaiser, "Oligodeoxyribonucleotides containing 1,3-propanediol as nucleoside substitute," Nucleic Acids Research 15:3113-3129 (1987).

Segarra et al., "Molecular characterization of the *Enterococcus faecalis* cytolysin activator," Infection and Immunity, 59, 4, 1239-1246 (1991) Database CAPLUS on STN, AN:1992:230597.

Senger et al., "Vascular permeability factor (VPF, VEGF) in tumor biology," Cancer and Matastasis Reviews 12:303-324 (1993).

Shabarova et al., "Chemical ligation of DNA: The first non-enyzmatic assembly of a biologically active gene," Nucleic Acids Research 19:4247-4251 (1991).

Sharp et al., "RNAi and double-strand RNA," Genes & Development, 13:139-141 (1999).

Sheehan et al., "Biochemical properties of phosphonoacetate and thiophosphonoacetate oligodeoxyribonucleotides," Nucleic Acids Research, 31 (14), 4109-4118 (2003).

Shibuya et al., "Nucleotide sequence and expression of a novel human receptor-type tyrosine kinase gene (flt) closely related to the fms family," Oncogene 5:519-524 (1990).

Shifren et al., "Ovarian Steroid Regulation of Vascular Endothelial Growth Factor in the Human Endometrium: Implications for Angiogenesis during the Menstrual Cycle and in the Pathogenesis of Endometriosis," The Journal of Clinical Endocrinology & Metabolism 81:3112-3118 (1996).

Shweiki et al., "Patterns of Expression of Vascular Endothelial Growth Factor (VEGF) and VEGF Receptors in Mice Suggest a Role in Hormonally Regulated Angiogenesis," J. Clin. Invest. 91:2235-2243 (1993).

Silverman et al., "Selective RNA Cleavage by Isolated RNase L Activated with 2-5A Antisense Chimeric Oligonucleotides," Methods in Enzymology 313:522-533 (1999).

Silverstein, "Use of a new device, the MircoWick to deliver medication to the inner ear," ENT—Ear Nose & Throat Journal, 78(8):595-600 (1999).

Silvestri et al., "CYP Enzyme Polymorphisms and Susceptibility to HCV-related Chronic Liver Disease and Liver Cancer," Int. J. Cancer, 104:310-317 (2003).

Simantov et al., "Dopamine-Induced Apoptosis in Human Neuronal Cells: Inhibition by Nucleic Acids Antisense to the Dopamine Transporter," Neuroscience 74(1):39-50 (1996).
Snyder et al., "Defining Genes in the Genomics Era," Science, 300, 258-260 (2003).
Sommer et al., "The Spread and Uptake Pattern of Intracerebrally Administered Oligonucleotides in Nerve and Glial Cell Populations of the Rat Brain," Antisense & Nucleic Acid Drug Development 8:75-85 (1998).
Stein and Cheng, "Antisense Oligonucleotides as Therapeutic Agents—Is the Bullet Really Magical?" Science 261:1004-1288 (1993).
Stein et al., "A Specificity Comparison of Four Antisense Types: Morpholino, 2'-O-Methyl RNA, DNA, and Phosphorothioate DNA," Antisense & Nucleic Acid Drug Development 7:151-157 (1997).
Strauss, Evelyn, "Molecular Biology: Candidate 'Gene Silencers' Found," Molecular Biology, vol. 286, No. 5441, p. 886 (1999) [sometimes mistakenly referred to as being published in Science].
Strobel and Dervan, "Site-Specific Cleavage of a Yeast Chromosome by Oligonucleotide-Directed Triple-Helix Formation," Science 249:73-75 (1990).
Strobel et al., "Exocyclic Amine of the Conserved G•U Pair at the Cleavage Site of the Tetrahymena Ribozyme Contributes to 5'-Splice Site Selection and Transition State Stabilization," Biochemistry 35:1201-1211 (1996).
Strobel et al., "Minor Groove Recognition of the Conserved G•U Pair at the Tetrahymena Ribozyme Reaction Site," Science 267:675-679 (1995).
Sullenger and Cech, "Ribozyme-mediated repair of defective mRNA by targeted trans-splicing," Nature 371:619-622 (1994).
Sullenger and Cech, "Tethering Ribozymes to a Retroviral Packaging Signal for Destruction of Viral RNA," Science 262:1566-1569 (1993).
Sullenger et al., "Overexpression of TAR Sequences Renders Cells Resistant to Human Immunodeficiency Virus Replication," Cell 63:601-608 (1990).
Sun, "Technology evaluation: SELEX, Giliad Sciences Inc," Current Opinion in Molecular Therapeutics 2:100-105 (2000).
Szostak and Ellington, "Ch. 20—In Vitro Selection of Functional RNA Sequences," in The RNA World, edited by Gesteland and Atkins, Cold Spring Harbor Laboratory Press, pp. 511-533 (1993).
Szostak, "In Vitro Genes," TIBS 17:89-93 (1993).
Taira et al., "Construction of a novel RNA-transcript-trimming plasmid which can be used both in vitro in place of run-off and (G)-free transcriptions and in vivo as multi-sequences transcription vectors," Nucleic Acids Research 19:5125-5130 (1991).
Takahashi et al., "Markedly Increased Amounts of Messenger RNAs for Vascular Endothelial Growth Factor and Placenta Growth Factor in Renal Cell Carcinoma Associated with Angiogenesis," Cancer Research 54:4233-4237 (1994).
Takeshita et al., "Efficient delivery of small interfering RNA to bone-metastatic tumors by using atelocollagen in vivo," PNAS, 102, 12177-12182 (2005).
Tang et al., "Examination of the catalytic fitness of the hammerhead ribozyme by in vitro selection," RNA 3:914-925 (1997).
Thomas et al., "Enhancing polyethylenimine's delivery of plasmid DNA into mammalian cells," PNAS, 99, 14640-14645 (2002).
Thompson et al., "Improved accumulation and activity of ribozymes expressed from a tRNA-based RNA polymerase III promoter," Nucleic Acids Research 23:2259-2268 (1995).
Torrence et al., "Targeting RNA for degradation with a (2'-5') oligoadenylate-antisense chimera," Proc. Natl. Acad. Sci. USA 90:1300-1304 (1993).
Turner et al., "Improved Parameters for Prediction of RNA Structure," Cold Spring Harbor Symposia on Quantitative Biology vol. LII, pp. 123-133 (1987).
Turner et al., "Free Energy Increments for Hydrogen Bonds in Nucleic Acid Base Pairs," J. Am. Chem. Soc. 109:3783-3785 (1987).
Tuschl et al., "Small Interfering RNAs: A Revolutionary Tool for Analysis of Gene Function and Gene Therapy," Molecular Interventions, 295, 3, 158-167 (2002).
Tuschl et al., "Targeted mRNA Degradation by Double-Stranded RNA In Vitro," Genes & Development 13:3191-3197 (1999).
Tuschl, "RNA Interference and Small Interfering RNAs," Chembiochem 2:239-245 (2001).
Tyler et al., "Peptide nucleic acids targeted to the neurotensin receptor and administered i.p. cross the blood-brain barrier and specifically reduce gene expression," Proc. Natl. Acad. Sci. USA 96:7053-7058 (1999).
Tyler et al., "Specific gene blockade shows that peptide nucleic acids readily enter neuronal cells in vivo," FEBS Letters 421:280-284 (1998).
Uhlmann and Peyman, "Antisense Oligonucleotides: A New Therapeutic Principle," Chemical Reviews 90:544-584 (1990).
Uhlmann et al., "Studies on the Mechanism of Stabilization of Partially Phosphorothioated Oligonucleotides Against Nucleolytic Degradation," Antisense & Nucleic Acid Drug Development 7:345-350 (1997).
Ui-Tei et al., "Guidelines for the selection of highly effective siRNA sequences for mammalian and chick RNA interference," Nucleic Acids Research, 32, 3, 936-948 (2004).
Usman and Cedergren, "Exploiting the chemical synthesis of RNA," TIBS 17:334-339 (1992).
Usman and McSwiggen, "Ch. 30—Catalytic RNA (Ribozymes) as Drugs," Annual Reports in Medicinal Chemistry 30:285-294 (1995).
Usman et al., "Automated Chemical Synthesis of Long Oligoribonucleotides Using 2'-O-Silylated Ribonucleoside 3'-O-Phosphoramidites on a Controlled-Pore Glass Support: Synthesis of a 43-Nucleotide Sequence Similar to the 3'-Half Molecule of an Escherichia coli Formylmethoionine tRNA," J. Am. Chem. Soc. 109:7845-7854 (1987).
Usman et al., "Chemical modification of hammerhead ribozymes: activity and nuclease resistance," Nucleic Acids Syposium Series 31:163-164 (1994).
Usman et al., "Hammerhead ribozyme engineering," Current Opinion in Structural Biology 1:527-533(1996).
Vaish et al., "Isolation of Hammerhead Ribozymes with Altered Core Sequences by in Vitro Selection," Biochemistry 36:6495-6501 (1997).
Vassar et al., "β-Secretase Cleavage of Alzheimer's Amyloid Precursor Protein by the Transmembrane Aspartic Protease BACE," Science 286:735-741 (1999).
Vaughn and Martienssen, "It's a Small RNA World, After All," Science, 309, 1525-1526 (2005).
Venkayya et al., The Th2 Lymphocyte Products IL-4 and IL-13 Rapidly Induce Airway Hyperresponsiveness Through Direct Effects on Resident Airway Cells., Am. J. Respir. Cell Mol. Biol., 26, 202-208 (2002).
Ventura et al., "Activation of HIV-Specific Ribozyme Activity by Self-Cleavage," Nucleic Acids Research 21:3249-3255 (1993).
Verdel et al., RNAi-Mediated Targeting of Heterochromatin by the RITS Complex, Science, 303, 672-676 (2004).
Verma and Eckstein, "Modified Oligonucleotides: Synthesis and Strategy for Users," Annu. Rev. Biochem. 67:99-134 (1998).
Vickers et al., "Efficient Reduction of Target RNAs by Small Interfering RNA and RNase H-dependent Antisense Agents," The Journal of Biological Chemistry, 278:9, 7108-7118 (2003).
Vogt et al., "Biology of the human hair follicle/New Insights and their clinical significance," Der Hautarzt, 54(8):692-698 (2003) Abstract Only—English.
Volpe et al., "Regulation of Heterochromatic Silencing and Histone H3 Lysine-9 Methylation by RNAi," Science 297:1833-1837 (2002).
Wang et al., "Delivery of Antisense Oligodeoxyribonucleotides Against the Human Epidermal Growth Factor Receptor into Cultured KB Cells with Liposomes Conjugated to Folate via Polyethylene Glycol," Proc. Natl. Acad. Sci. USA 92:3318-3322 (1995).
Waterhouse et al., "Virus resistance and gene silencing in plants can be induced by simultaneous expression of sense and antisense RNA," Proc. Natl. Acad. Sci. USA, 95, 13959-13964 (1998).
Weckbecker et al., "Intradermal angiogenesis in nude mice induced by human tumor cells or b-FGF," Angiogenesis Key Principles-Science-Technology-Medicine pp. 296-301 (1992).
Weerasinghe et al., "Resistance to Human Immunodeficiency Virus Type 1 (HIV-1) Infection in Human CD4+ Lymphocyte-Derived Cell Lines Conferred by Using Retroviral Vectors Expressing an HIV-1 RNA-Specific Ribozyme," Journal of Virology 65:5531-5534 (1994).

Wellstein and Czubayko, "Inhibition of Fibroblast Growth Factors," Breast Cancer Research and Treatment 38:109-119 (1996).

Wen et al., "Preparation and property analysis of a hepatocyte targeting pH-sensitive liposome," World J Gastroenterology, 10(2):244-249 (2004).

Werner and Uhlenbeck, "The effect of base mismatches in the substrate recognition helices of hammerhead ribozymes on binding and catalysis," Nucleic Acids Research 23:2092-2096 (1995).

Wianny and Zernicka-Goetz et al., "Specific Interference with Gene Function by Double-Stranded RNA in Early Mouse Development," Nature Cell Biology 2:70-75 (2000).

Wills-Karp et al., Interleukin-13: Central Mediator of Allergic Asthma, Science, 282, 2258-2261 (1998).

Wincott et al., "Synthesis, deprotection, analysis and purification of RNA and ribozymes," Nucleic Acids Research 23(14):2677-2684 (1995).

Wincott et al., "A Practical Method for the Production of RNA and Ribozymes," Methods in Molecular Biology 74:59-69 (1997).

Witkin et al., "Influence of Interleukin-1 Receptor Antagonist Gene Polymorphism on Disease," Clinical Infectious Diseases, 34:204-209 (2002).

Woo et al., "Taxol Inhibits Progression of Congenital Polycystic Kindey Disease," Nature 368:750-753 (1994).

Woolf et al., "Specificity of Antisense Oligonucleotides in vivo," Proc. Natl. Acad. Sci. USA 89:7305-7309 (1992).

Wraight et al., "Anitsense oligonucleotides in cutaneous therapy," Pharmacology & Therapeutics, 90, 89-104 (2001).

Wu and Kaufman, "A Model for the Double-stranded RNA (dsRNA)-dependent Dimerization and Activation of the dsRNA-activated Protein Kinase PKR*," The Journal of Biological Chemistry, 272:2, 1291-1296 (1997).

Wu and Wu, "Receptor-mediated in Vitro Gene Transformation by a Soluble DNA Carrier System," The Journ. of Biol. Chem. 262:4429-4432 (1987).

Wu et al., "Cardiac Defects and Renal Failure in Mice with Targeted Mutations in Pkd2," Nature Genetics 24:75-78 (2000).

Wu-Pong et al., "Nucleic Acid Drug Delivery, Part 2; Delivery to the Brain," BioPharm 32-38 (1999).

Yamada et al., "Nanoparticles for the delivery of genes and drugs to human hepatocytes," Nature Biology, Published online: Jun. 29, 2003, doi:10.1038/nbt843 (Aug. 2003, vol. 21, No. 8, pp. 885-890) (2003).

Yan et al., "Membrane-anchored Aspartyl Protease with Alzheimer's Disease β-Secretase Activity," Nature 402:533-537 (1999).

Yang et al., "Hydrodynamic injection of viral DNA: A mouse model of acute hepatitis B virus infection," PNAS, 99, 21, 13825-13830 (2002).

Yang et al., "Interleukin-13 Mediates Airways Hyperreactivity through the IL-4 Receptor-Alpha Chain and STAT-6 Independently of IL-5 and Eotaxin," Am. J. Respir Cell Mol. Biol., 25, 522-530 (2001).

Ying et al., "Intron-derived mircoRNAs—fine tuning of gene functions", Gene, 342, 25-28 (2004).

Yu et al., "A Hairpin Ribozyme Inhibits Expression of Diverse Strains of Human Immunodeficiency Virus Type 1," Proc. Natl. Acad. Sci. USA 90:6340-6344 (1993).

Yuan et al., "Targeted cleavage of mRNA by human RNase P," Proc. Natl. Acad. Sci. USA 89:8006-8010 (1992).

Zamore and Haley, "Ribo-gnome: The Big World of Small RNAs," Science, 309, 1519-1524 (2005).

Zamore et al., "RNAi: Double-Stranded RNA Directs the ATP-Dependent Cleavage of mRNA at 21 to 23 Nucleotide Intervals," Cell 101:25-33 (2000).

Zarrinkar and Williamson, "The P9.1-P9.2 peripheral extension helps guide folding of the Tetrahymena ribozyme," Nucleic Acids Research 24:854-858 (1996).

Zhang et al., "Targeted Gene Silencing by Small Interfering RNA-based Knock-Down Technology," Current Pharmaceutical Biotechnology, 5, 1-7 (2004).

Zhou et al., "Synthesis of Functional mRNA in Mammalian Cells by Bacteriophage T3 RNA Polymerase," Mol. Cell. Biol. 10:4529-4537 (1990).

Ziche et al., "Angiogenesis Can Be Stimulated or Repressed In Vivo by a Change in GM3:GD3 Ganglioside Ratio," Laboratory Investigation 67:711-715 (1992).

Zimmerly et al., "A Group II Intron RNA is a Catalytic Component of a DNA Endonuclease Involved in Intron Mobility," Cell 83:529-538 (1995).

Zinnen et al., "Chemically Modified siRNAa: Potential Anti-viral Hepatitis Therapeutics" (Abstract) Mar. 2004.

Alexeev et al., "Localized in vivo genotypic and phentypic correction of the albino mutation in skin by RNA-DNA oligonucleotide," *Nature Biotechnology*, 18:43-47 (2000).

Bellon et al., "4-Thio-oligo-β-D-ribonucleotides: synthesis of β-4'-thio-oligouridylates, nuclease resistance, base pairing properties, and interaction with HIV-1 reverse transcriptase," *Nucleic Acids Research*, 21(7):1587-1593 (1993).

Bitko et al., "Phenotypic silencing of cytoplasmic genes using sequence-specific double-stranded short interfering RNA and its application in the reverse genetics of wild type negative-strand RNA viruses," *BMC Microbiology*, 1:34 (2001).

Braasch et al., "Novel Antisense and Peptide Nucleic Acid Strategies for Controlling Gene Expression," *Biochemistry*, 31:14, 4503-4510 (2002).

Braasch et al., "RNA Inteference in Mammalian Cells by Chemically-Modified RNA," *Biochemistry*, 42, 7967-7975 (2003).

Claverie, Jean-Michel, "Fewer Genes, More Noncoding RNA," *Science*, 309, 1529-1530 (2005).

Elbashir et al., "Analysis of gene function in somatic mammalian cells using small interfering RNAs," *Methods*, 26:199-213 (2002).

Hamasaki et al., "Short interfering RNA-directed inhibition of hepatitis B virus replication," *FEBS Letters*, 543:51-54 (2003).

Holen et al., "Positional effects of short interfering RNAs targeting the human coagulation trigger Tissue Factor," *Nucleic Acids Research*, 30:8, 1757-1766 (2002).

Hornung et al., "Sequence-specific potent induction of IFN-α by short interfering RNA in plasmacytoid dendritic cells through TLR7," *Nature Medicine*, 11, 263-270 (2005).

Judge et al., "Sequence-dependent stimulation of the mammalian innate immune response by synthetic siRNA," *Nature Biotechnology*, 23(4):457-462 (2005).

Kawaski et al., "Uniformly Modified 2'-Modified 2'-Deoxy-2'-fluoro Phosphorothioate Oligonucleotides as Nuclease-Resistant Antisense Compounds with High Affinity and Specificity for RNA Targets," *J. Med. Chem.*, 36, 831-841 (1993).

Mattick, John S., "The Functional Genomics of Noncoding RNA", Science, 309, 1527-1528 (2005).

McCaffrey et al., "RNA interference in adult mice," Nature, 148, 38-39 (2002).

Monia et al., "Evaluation of 2'-Modified Oligonucleotides Containing 2'-Deoxy Gaps as Antisense Inhibitors of Gene Expression," *J. Biol. Chem.* 268:14514-14522 (1993).

Morvan et al., "Comparative Evaluation of Seven Oligonucleotide Analogues as Potential Antisense Agents," *J. Med. Chem.*, 36, 280-287 (1993).

Olie et al., "Analysis of ribosyl-modified, mixed backbone analogs of a bcl-2/bcl-xL antisense oligonucleotide," *Biochimica et Biophysica Acta*, 1576, 101-109 (2002).

Opalinska et al., "Nucleic-Acid Therapeutics: Basic Principles and Recent Applications," *Nature Reviews Drug Discovery*, (1):503-514 (2002).

Pavco et al., "Antitumor and Antimetastatic Activity of Ribozymes Targeting the Messenger RNA of Vascular Endothelial Growth Factor Receptors," *Clinical Cancer Research* 6:2094-2103 (2000).

Thomson et al., "Activity of hammerhead ribozymes containing non-nucleotidic linkers," *Nucleic Acids Research* 21:5600-5603 (1993) (May Be Referred To As Thompson).

Vickers et al., "Efficient Reduction of Target RNAs by Small Interfering RNA and RNase H-dependent Antisense Agents," *Journal of Biological Chemistry*, 278, 7108-7118 (2003).

\* cited by examiner

Figure 1
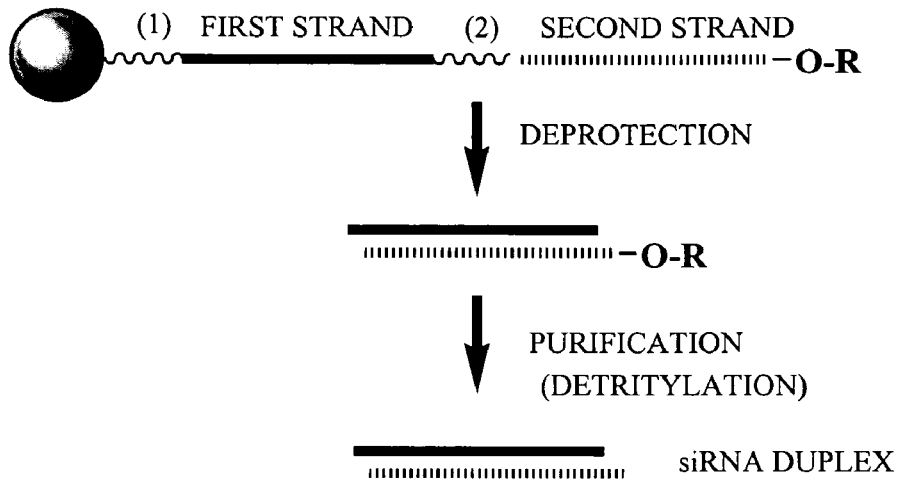
 = SOLID SUPPORT
R = TERMINAL PROTECTING GROUP
FOR EXAMPLE:
DIMETHOXYTRITYL (DMT)
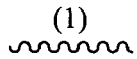 = CLEAVABLE LINKER
(FOR EXAMPLE: NUCLEOTIDE SUCCINATE OR INVERTED DEOXYABASIC SUCCINATE)
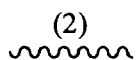 = CLEAVABLE LINKER
(FOR EXAMPLE: NUCLEOTIDE SUCCINATE OR INVERTED DEOXYABASIC SUCCINATE)
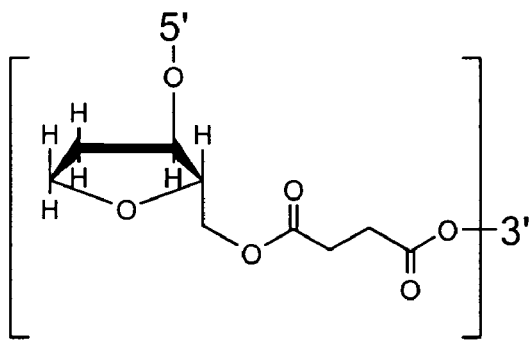
INVERTED DEOXYABASIC SUCCINATE LINKAGE
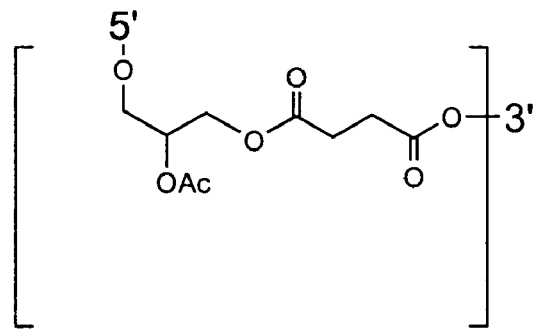
GLYCERYL SUCCINATE LINKAGE n = 0, 1, 2, 3, 4

Figure 6C

```
                           11th nucleotide position based on
                           5'-end of guide strand
                           ↓
1.  5'-         B-N N N N N N N{N N N N N N N N N N N (N N)-B   -3'
2.  3'-   B-(N N) N N N N N N N N N N N N N N N N N N N          -5'
3.  5'-------[N N] N N N N N N N N N N N N N N N N N N N N ---------- -3'
```

1. = sense strand (passenger strand)
2. = antisense strand (guide strand)
3. = target polynucleotide sequence The guide strand is complementary to the target sequence and the passenger strand is complementary to the guide strand. Overhang nucleotides (NN) in the guide strand can be complementary to nucleotides [NN] in target sequence. Overhang nucleotides (NN) in the passenger strand can comprise nucleotides [NN] in target sequence. Position $N$ of the passenger strand can comprise a ribonucleotide. For the representative 19 base pair 21 mer duplex shown, position $N$ is 9 nucleotides in from the 3' end of the passenger strand. However, in duplexes of differing length, the position $N$ is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow.
Representative 2 nucleotide overhangs are shown, but can vary for example from 0 to about 4 nucleotides.
B = terminal cap which can be present or absent
This generalized motif can be applied to all Stab 00-34 chemistries herein.

R = O, S, N, alkyl, substituted alkyl, O-alkyl, S-alkyl, alkaryl, or aralkyl
B = Independently any nucleotide base, either naturally occurring or chemically modified, or optionally H (abasic).

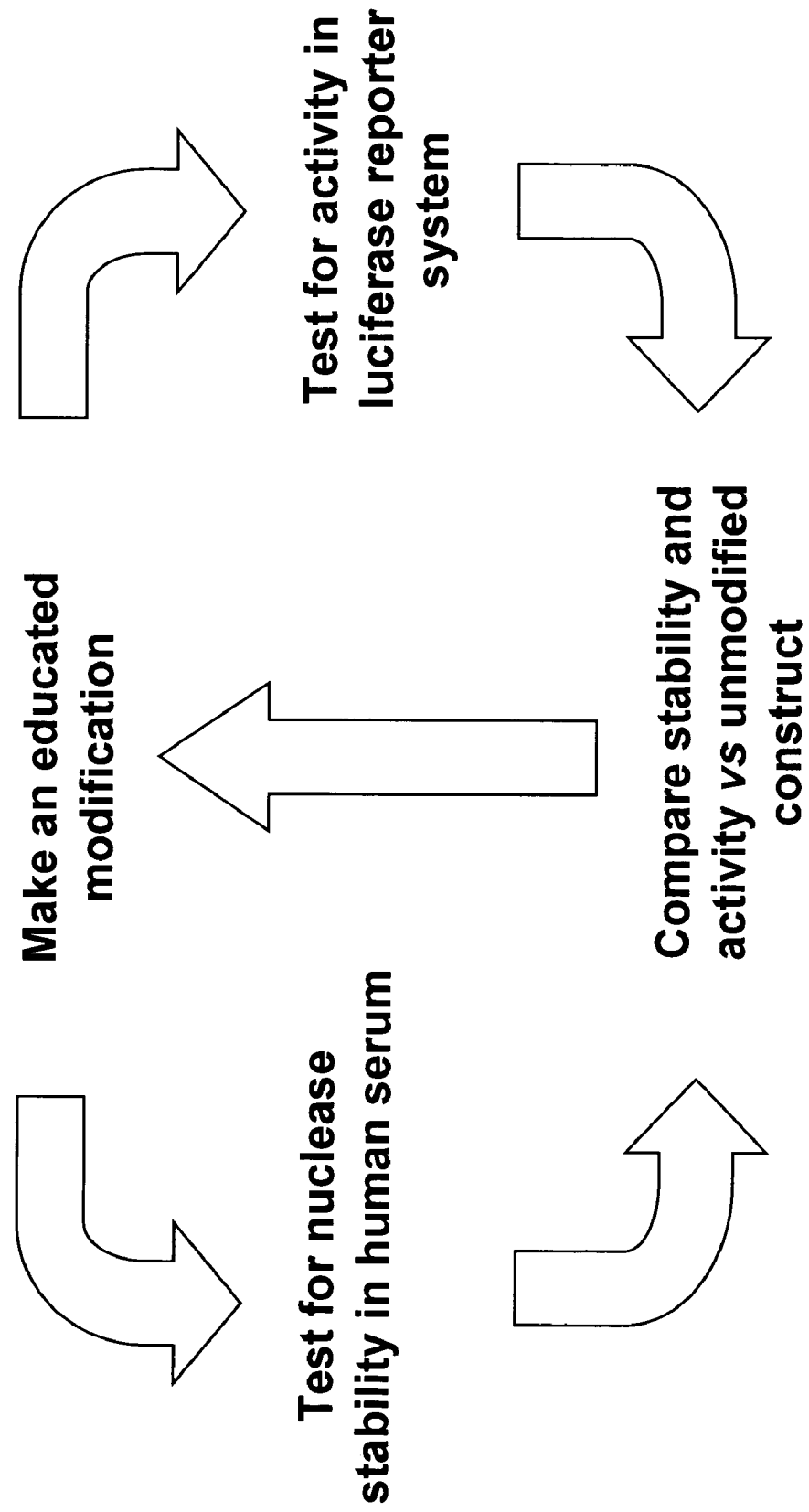
Figure 11: Modification Strategy

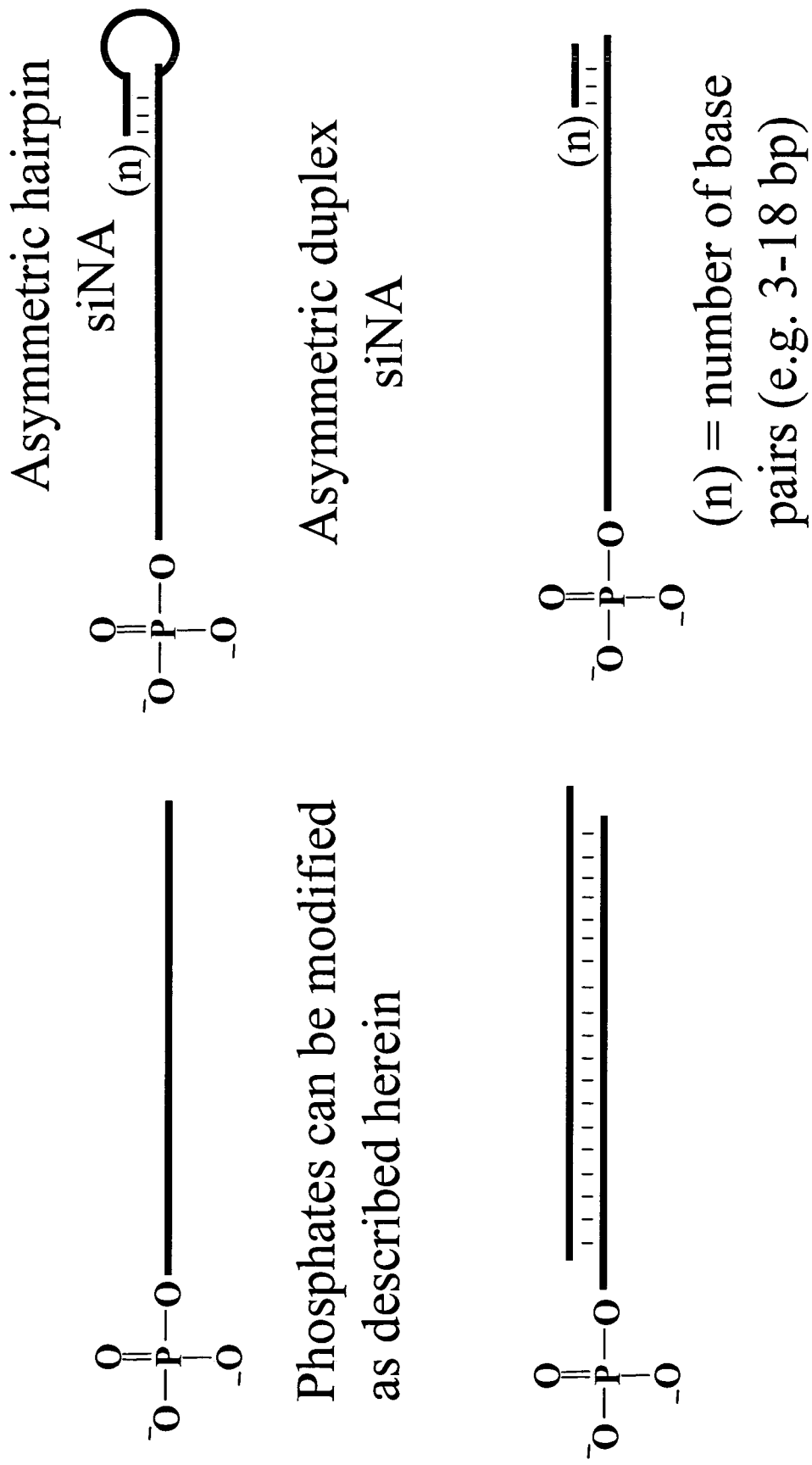
Figure 12: Phosphorylated siNA constructs

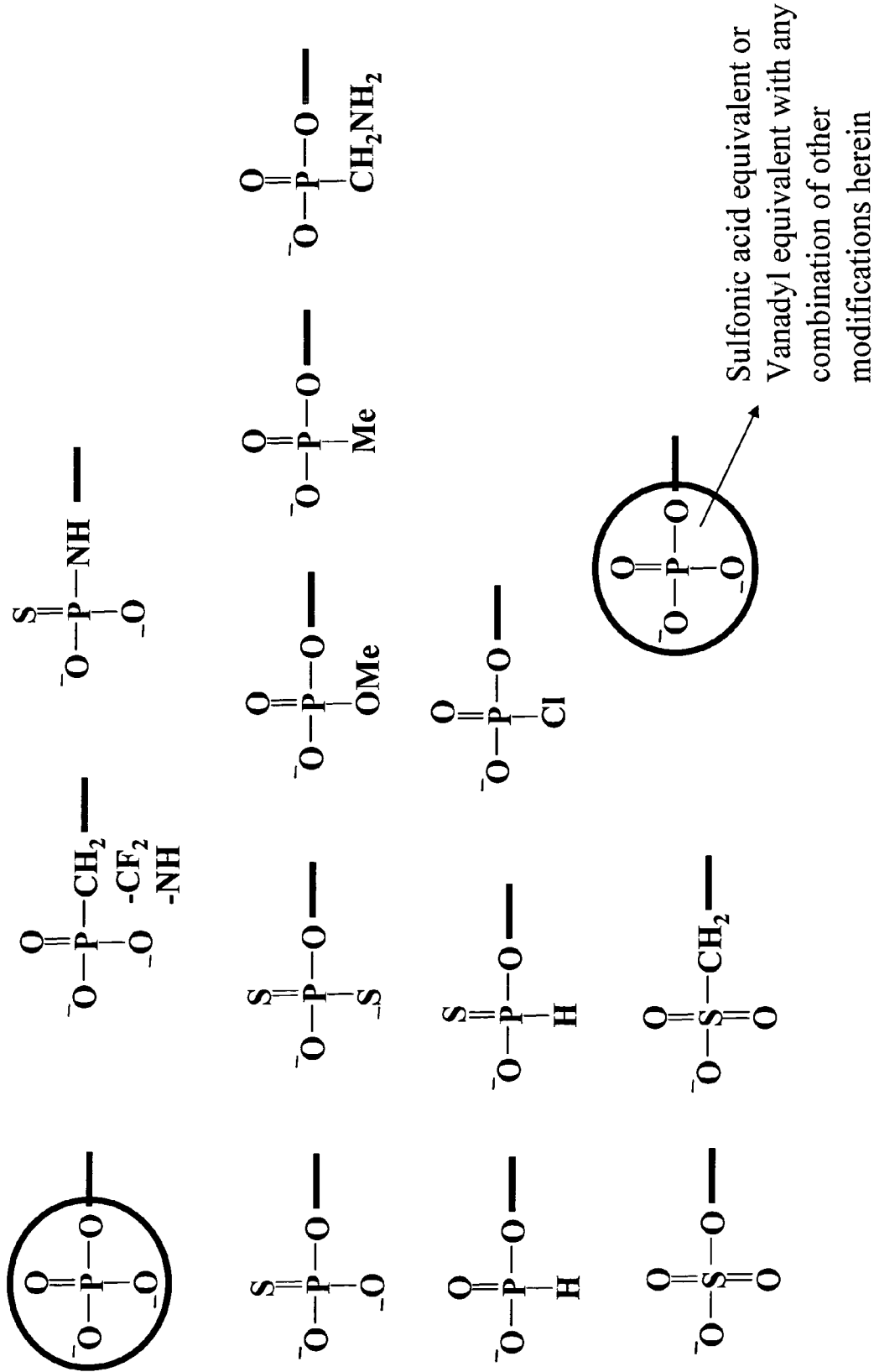
*Figure 13: 5'-phosphate modifications*

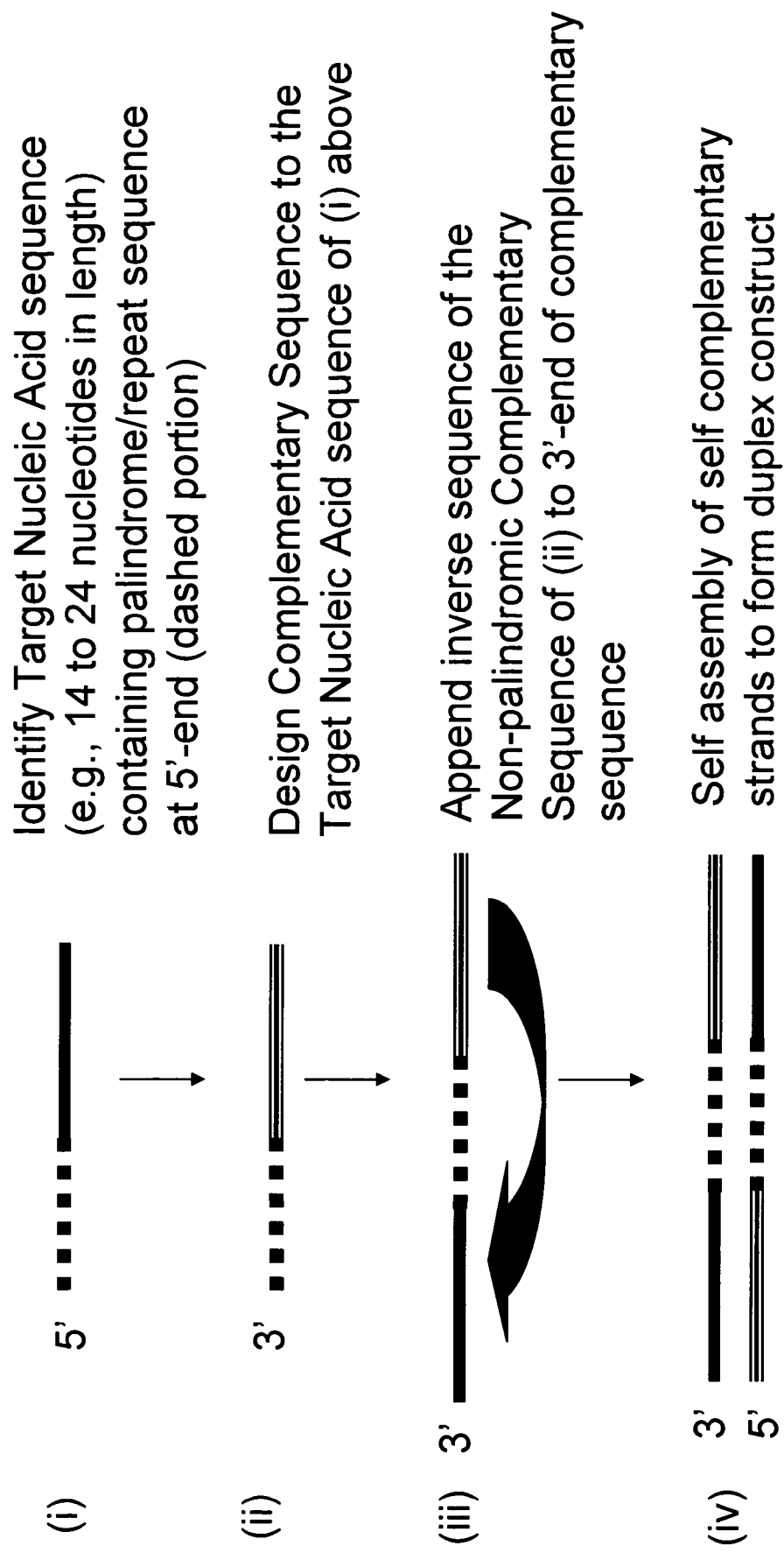

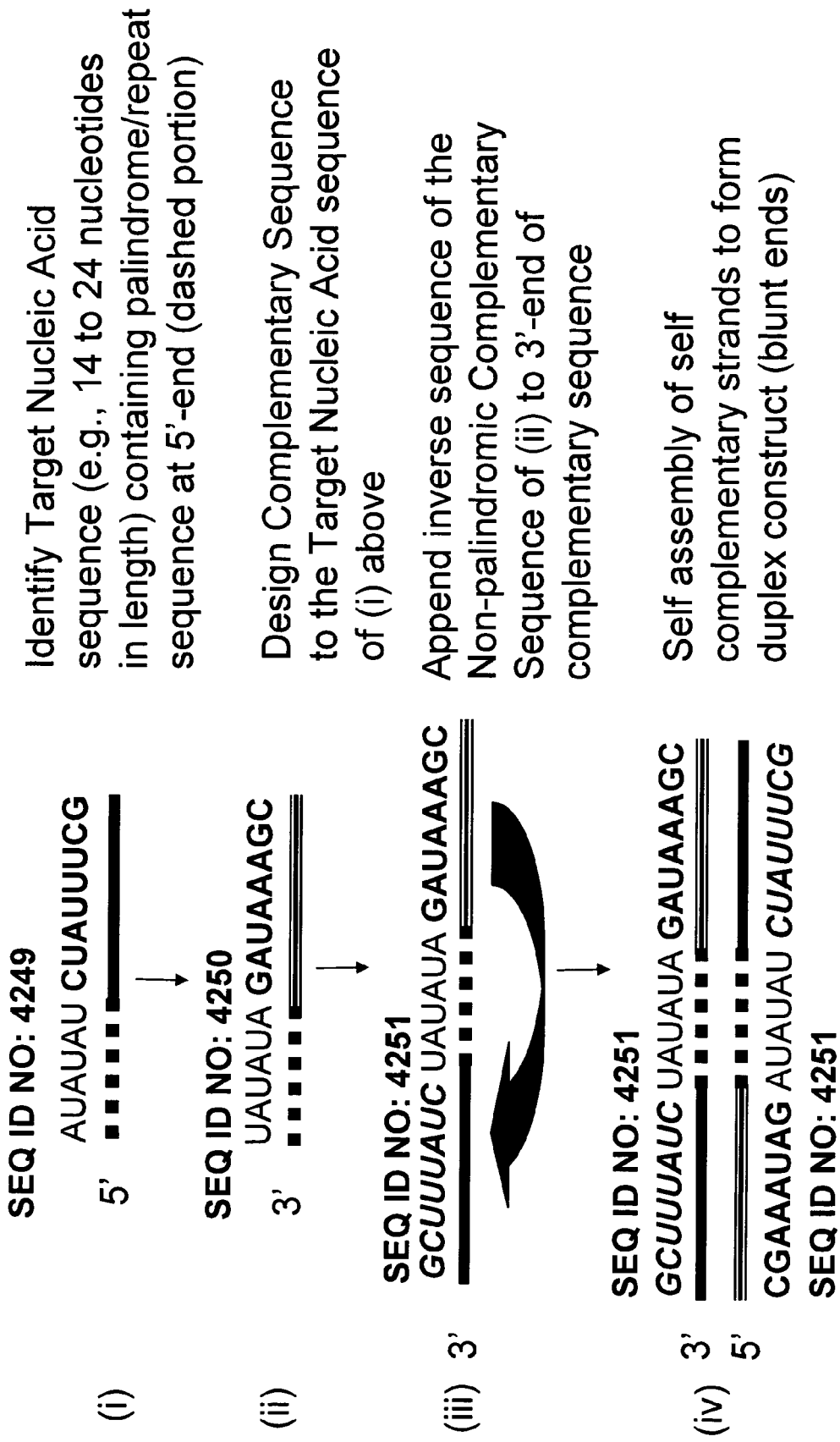
Figure 14B: Example of a duplex forming oligonucleotide sequence that utilizes a palindrome or repeat sequence

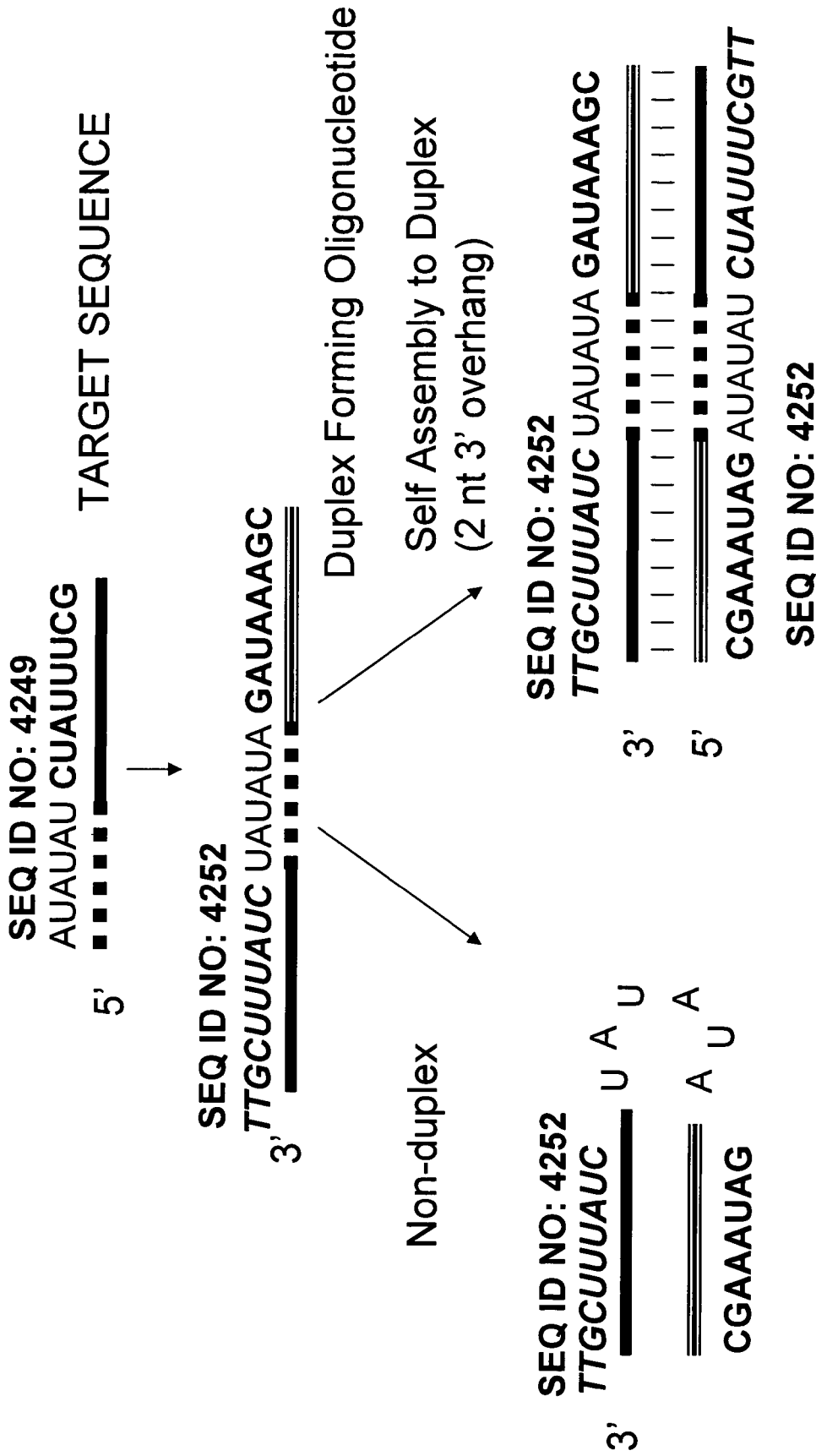
Figure 14C: Example of a duplex forming oligonucleotide sequence that utilizes a palindrome or repeat sequence, self assembly

Figure 14D: Example of a duplex forming oligonucleotide sequence that utilizes a palindrome or repeat sequence, self assembly and inhibition of Target Sequence Expression

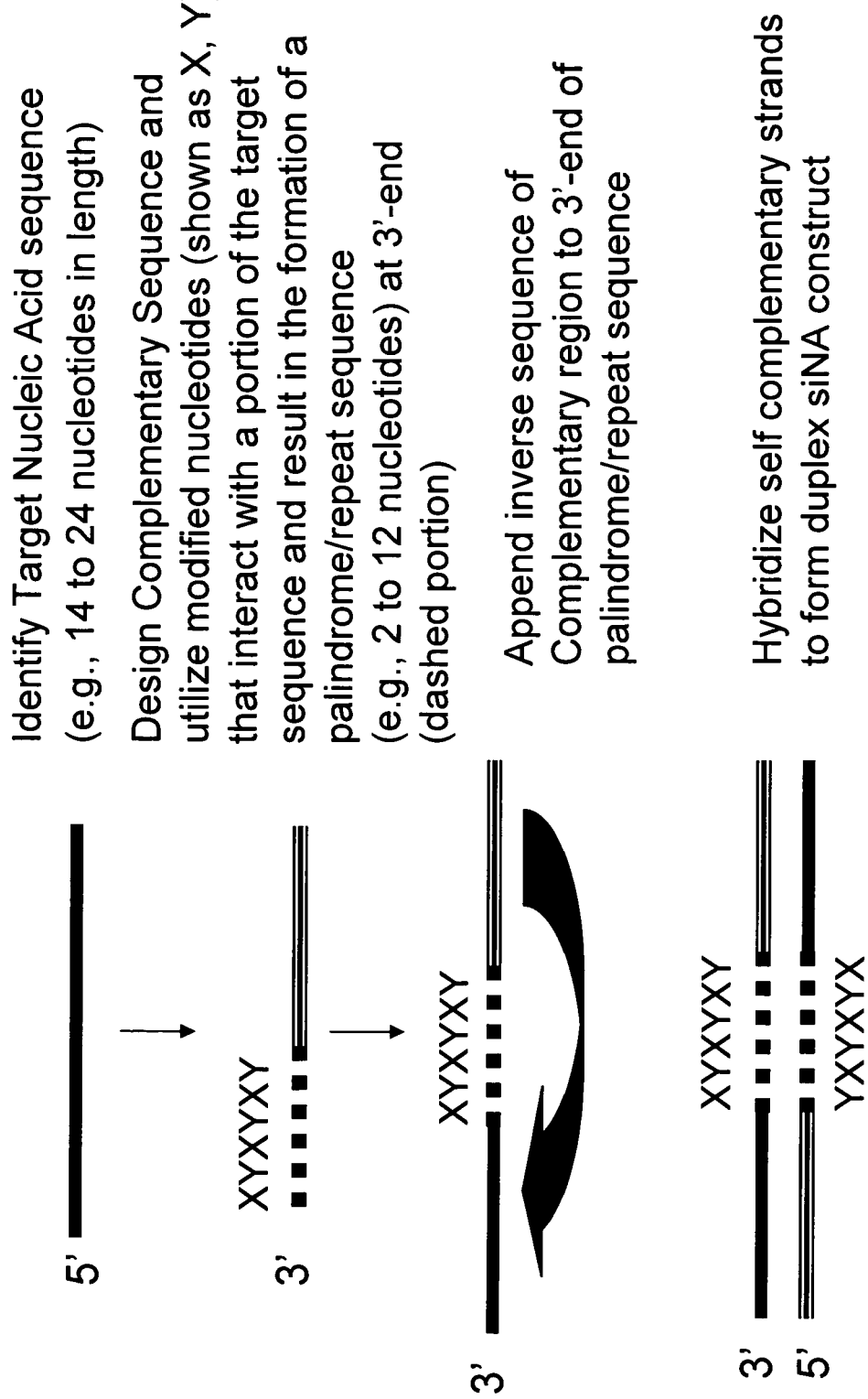
Figure 15: Duplex forming oligonucleotide constructs that utilize artificial palindrome or repeat sequences

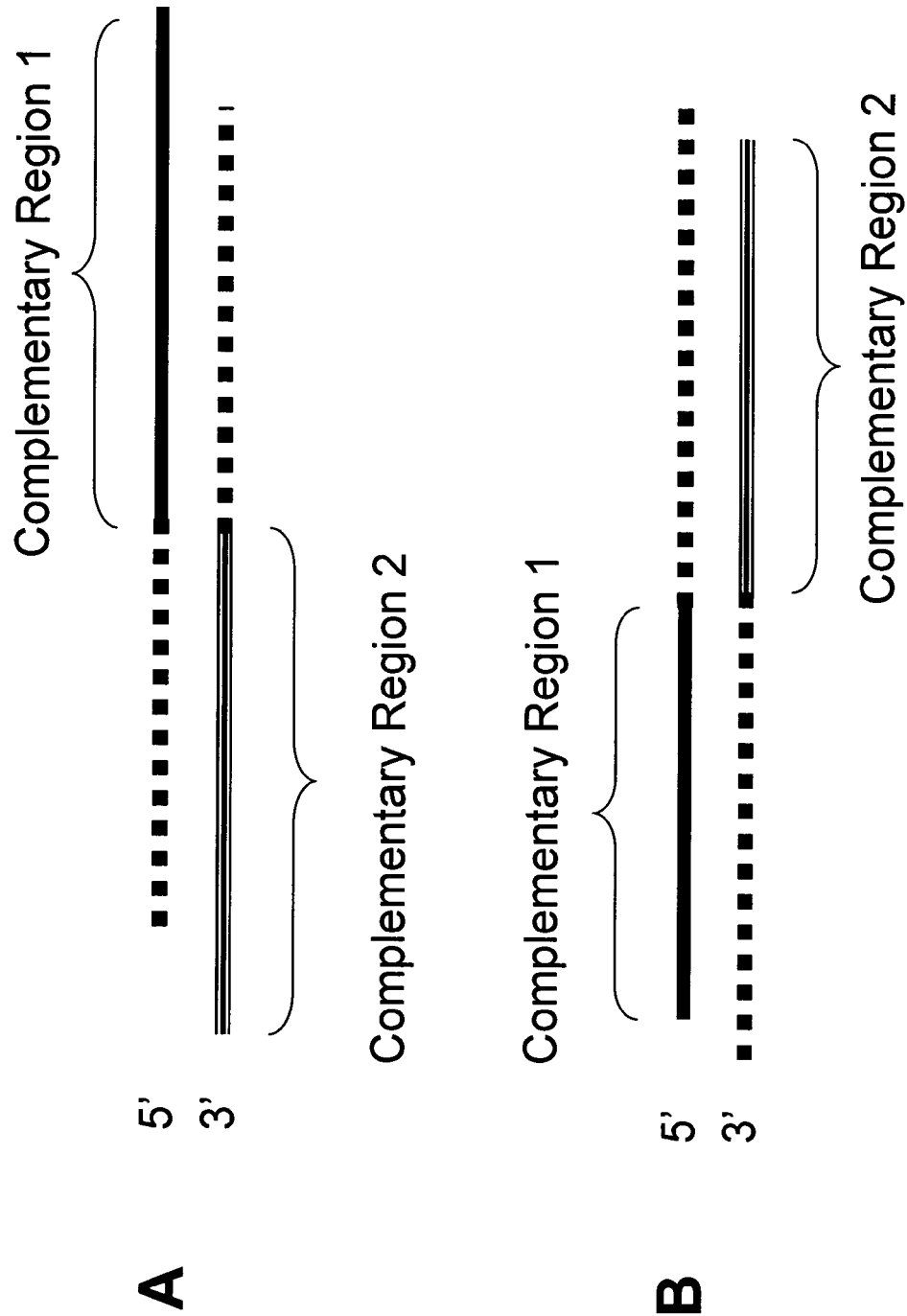
*Figure 16: Examples of double stranded multifunctional siNA constructs with distinct complementary regions*

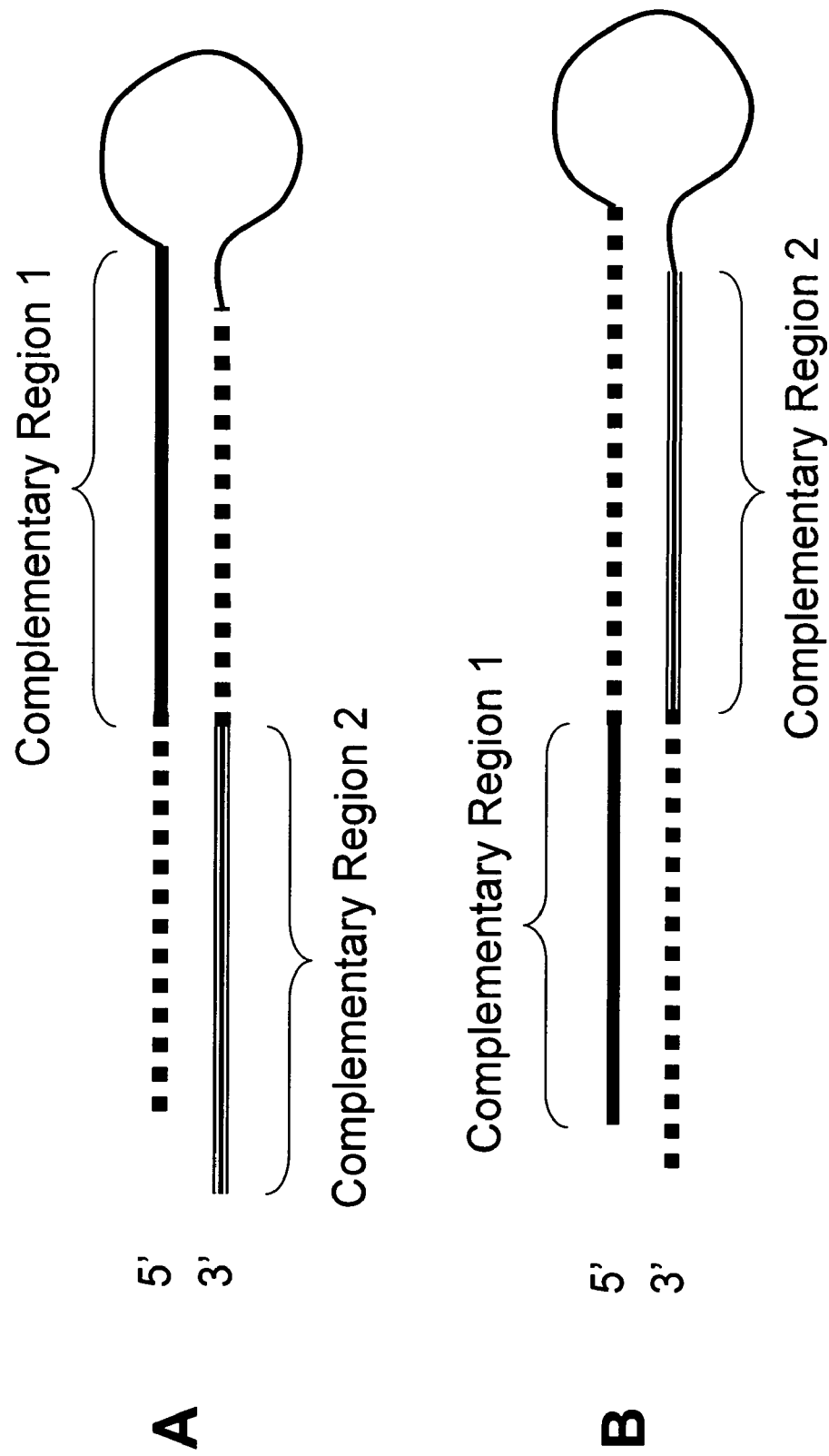
Figure 17: Examples of hairpin multifunctional siNA constructs with distinct complementary regions

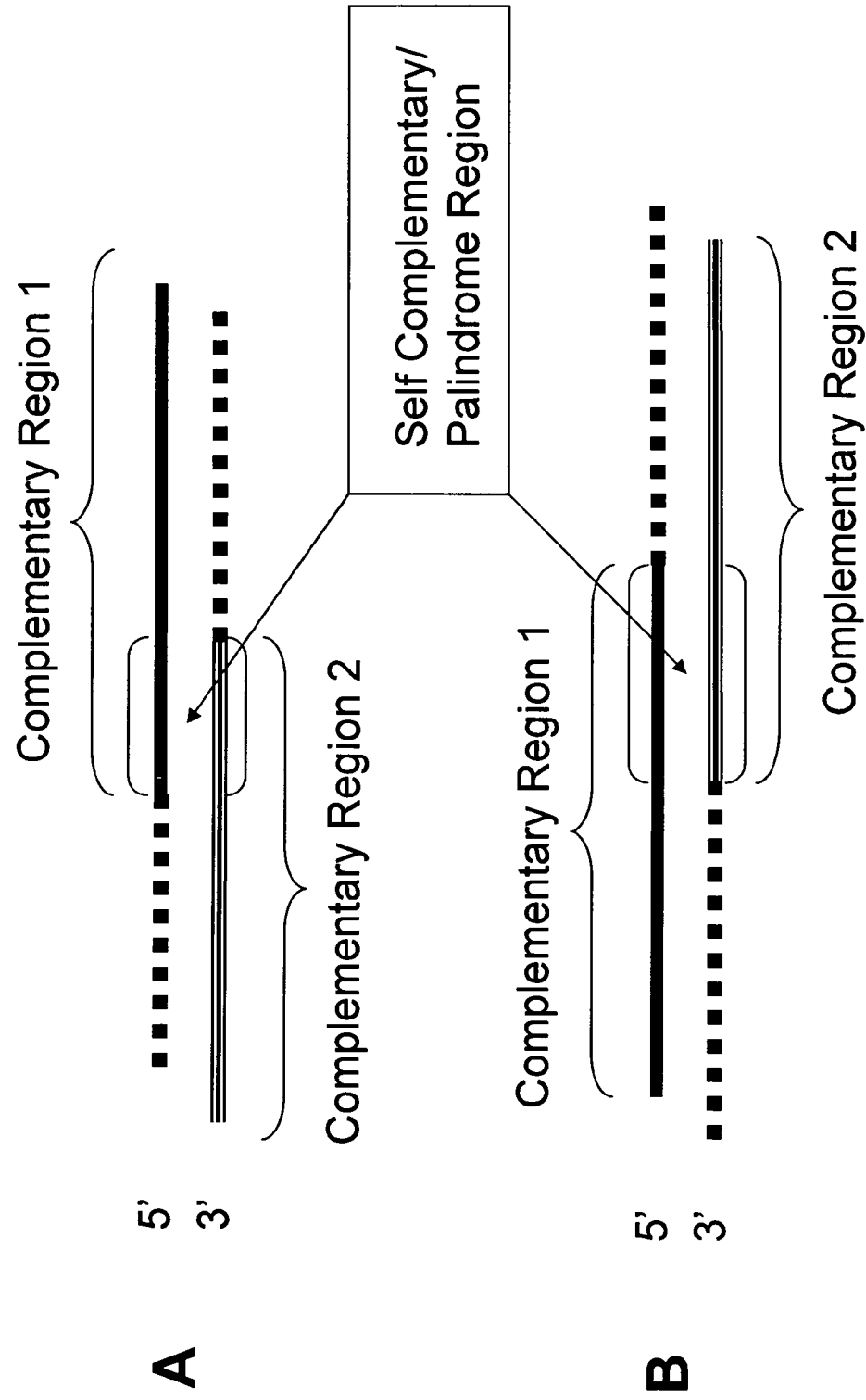
Figure 18: Examples of double stranded multifunctional siNA constructs with distinct complementary regions and a self complementary/palindrome region

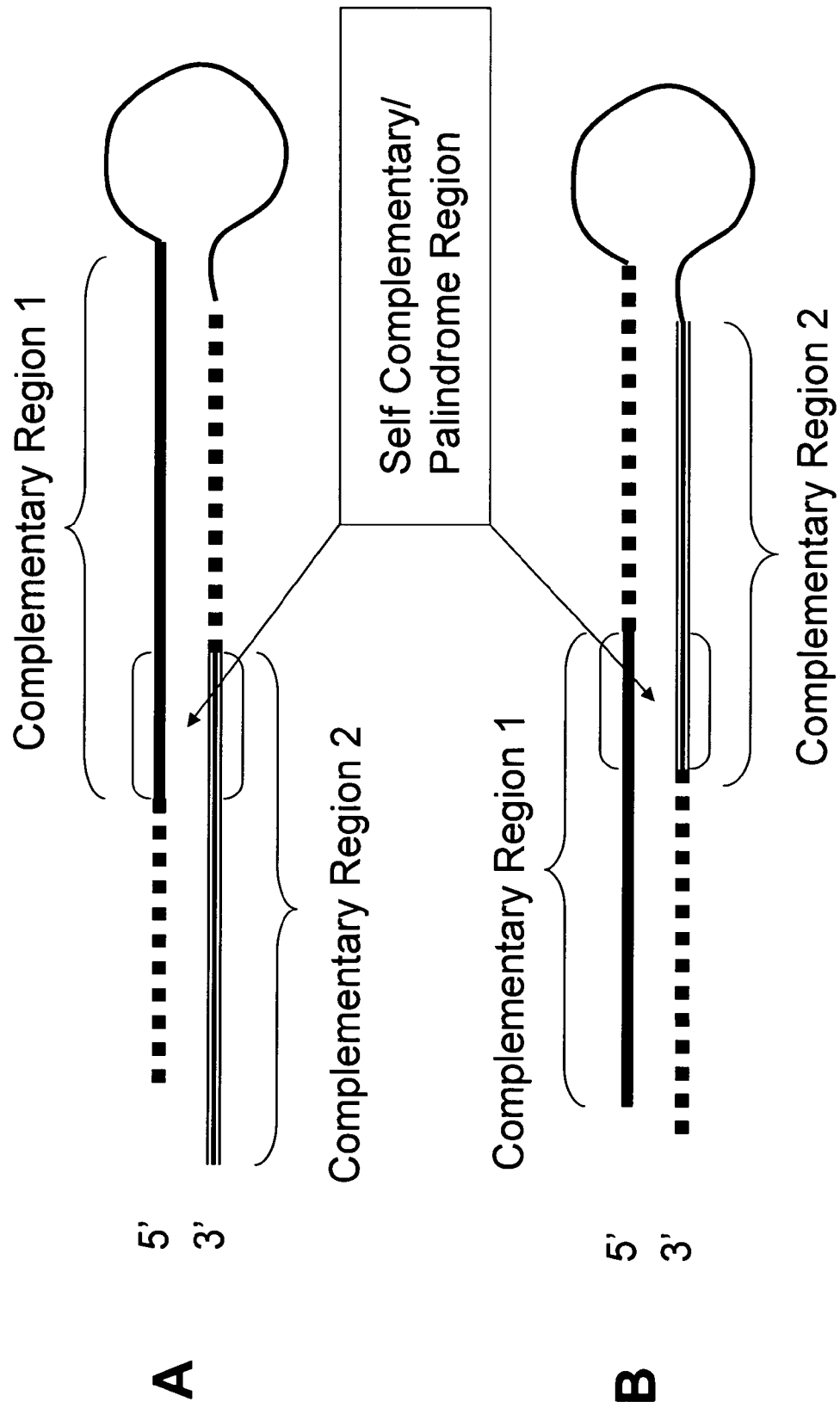
Figure 19: Examples of hairpin multifunctional siNA constructs with distinct complementary regions and a self complementary/palindrome region

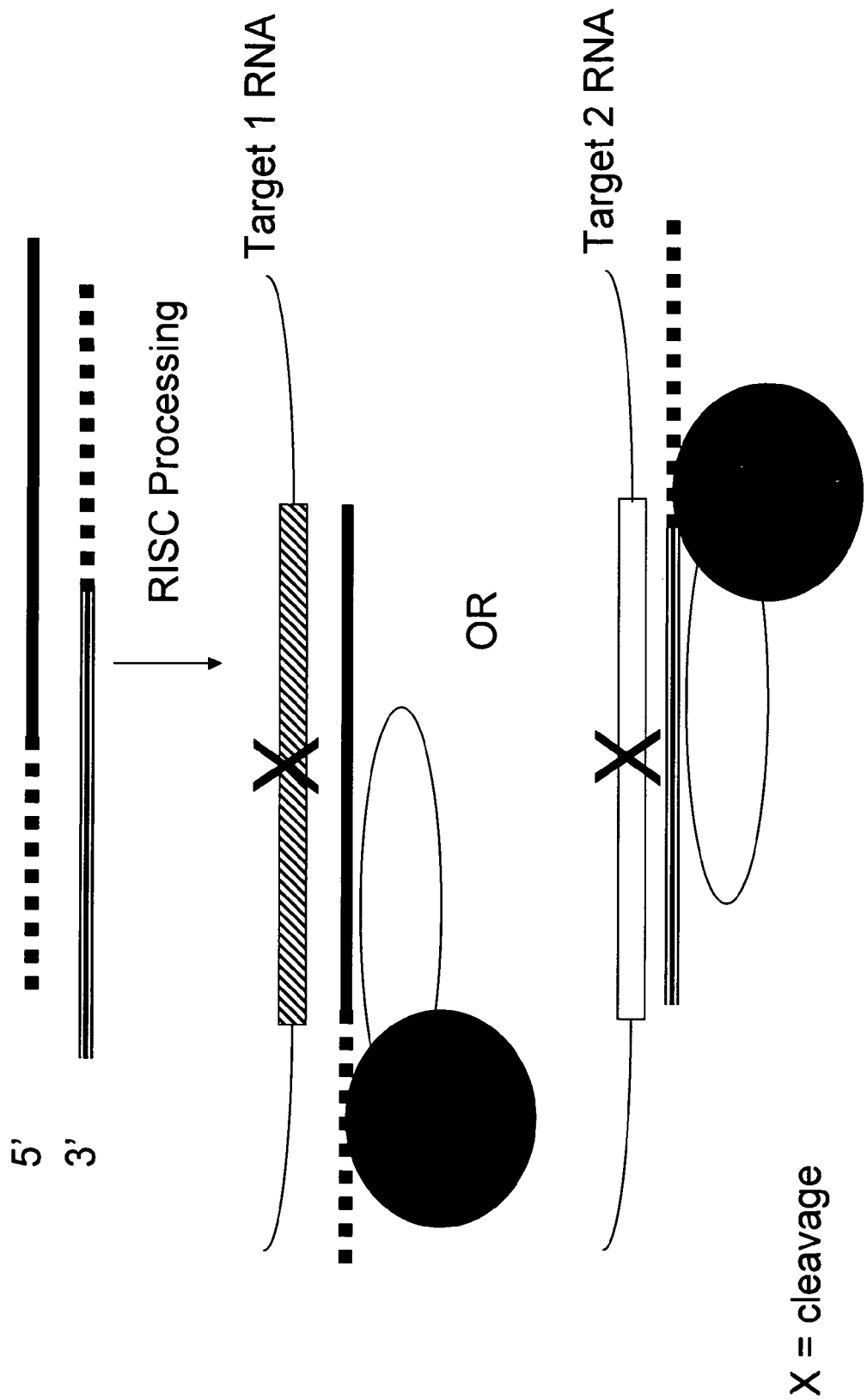
Figure 20: Example of multifunctional siNA targeting two Separate Target nucleic acid sequences

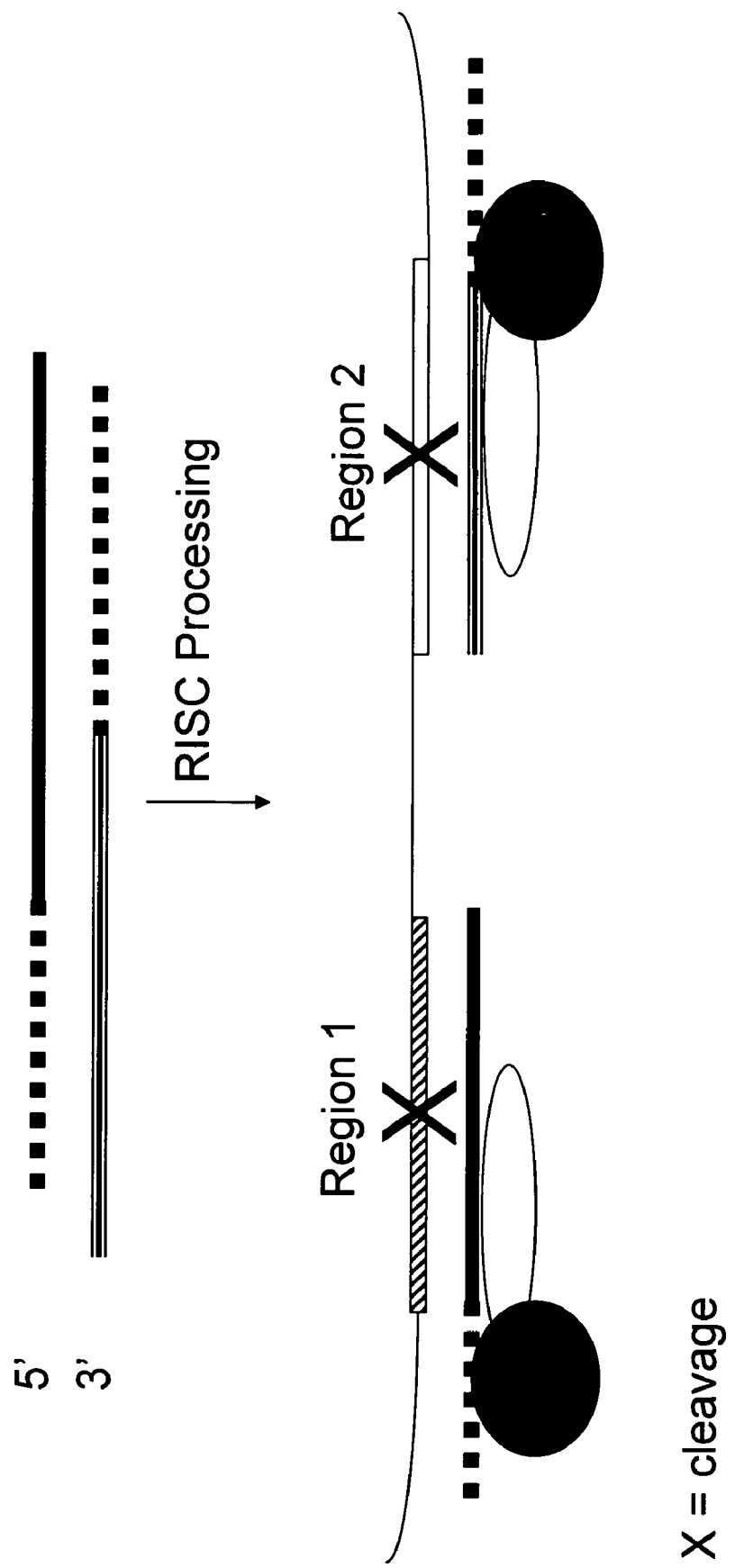
Figure 21: Example of multifunctional siNA targeting two regions within the same target nucleic acid sequence

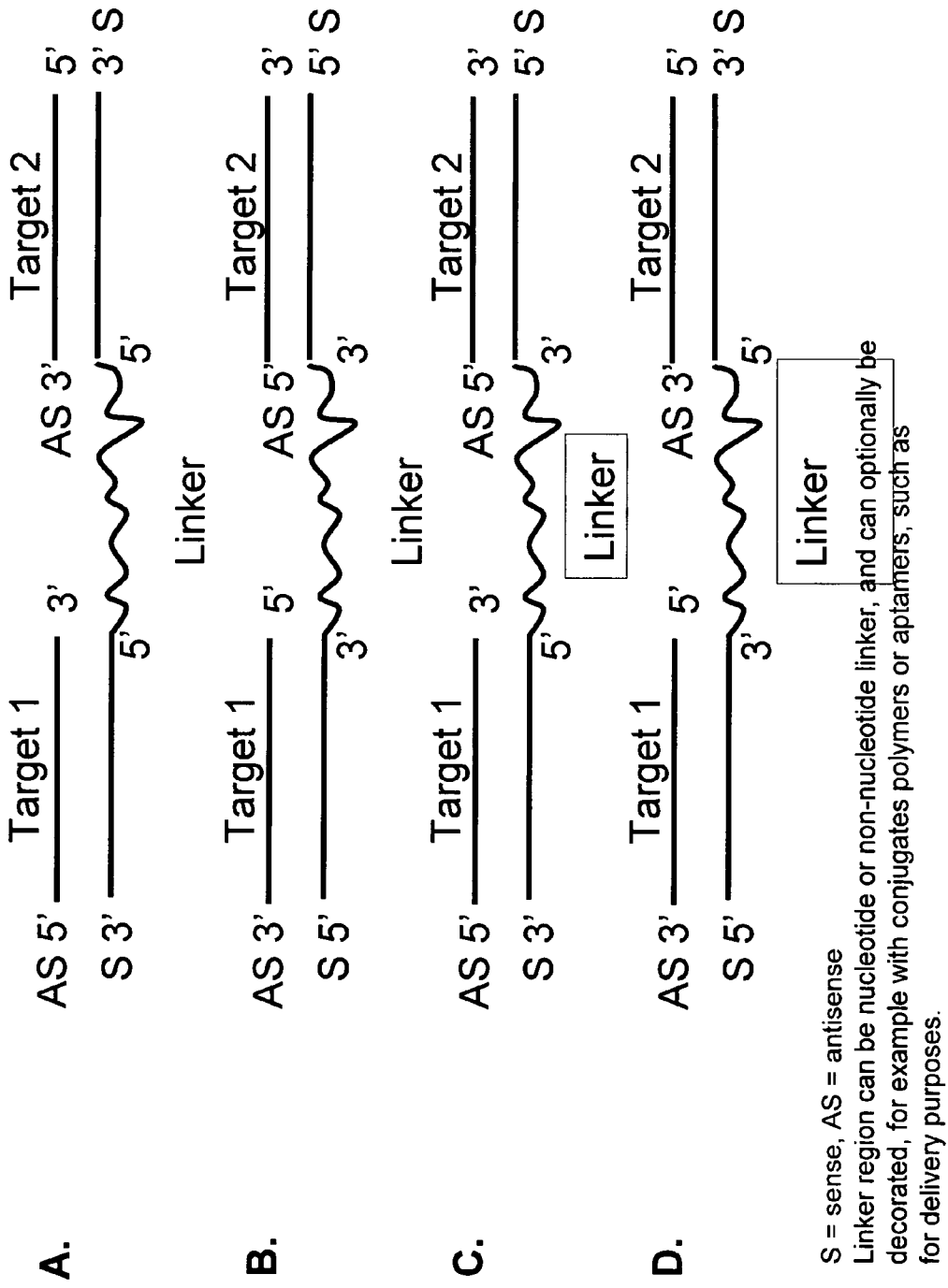
Figure 22: Tethered Multifunctional siNA design

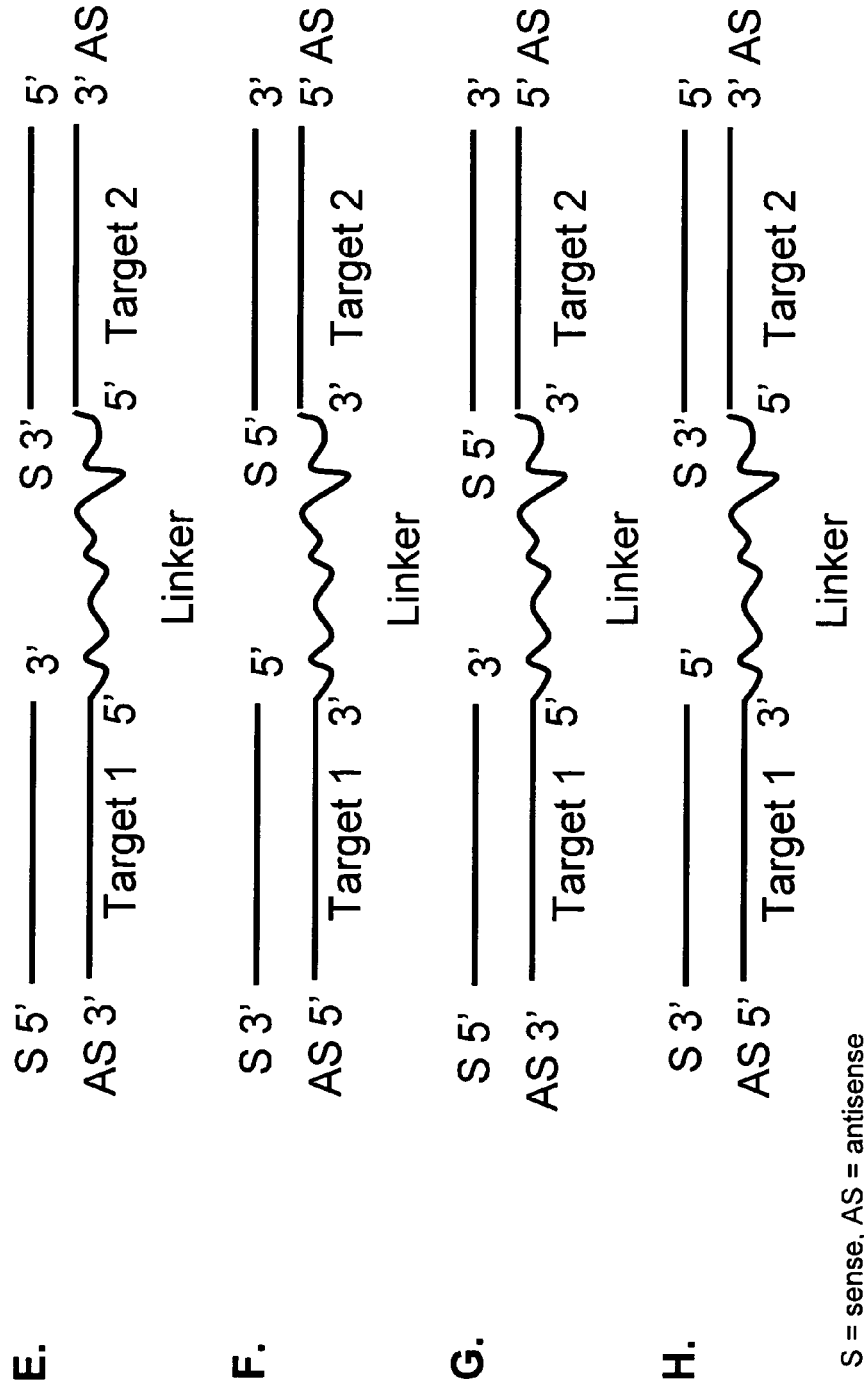
*Figure 22:* Tethered Multifunctional siNA design

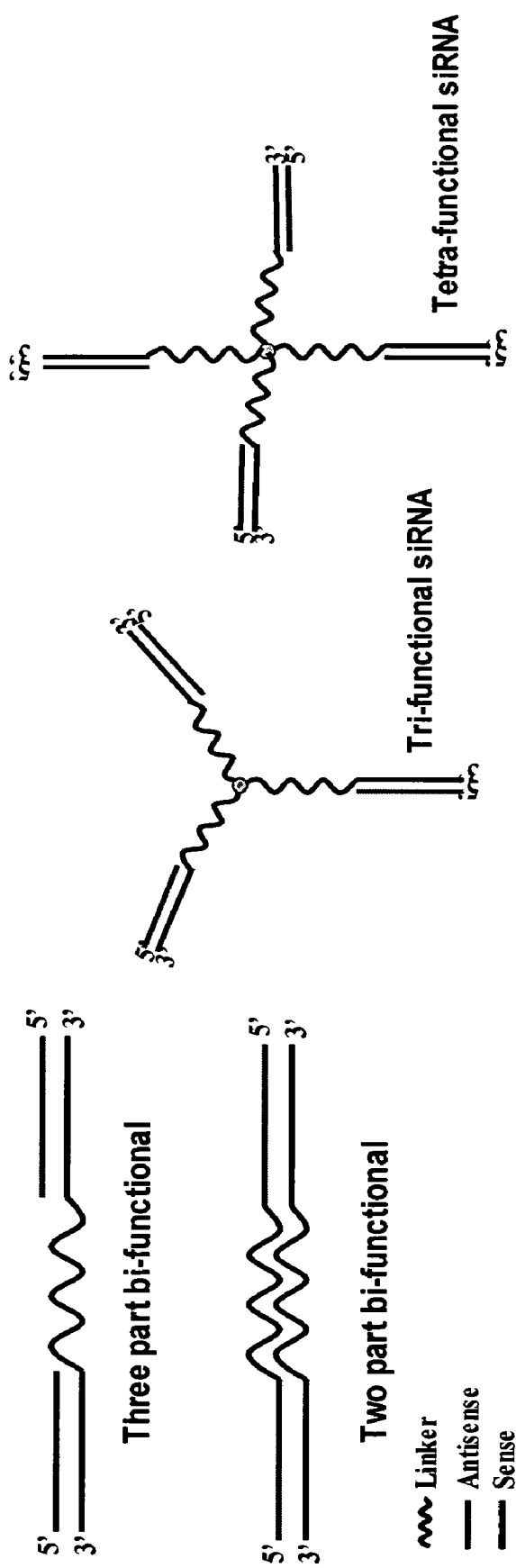
*Figure 23: Dendrimer Multifunctional siNA designs*

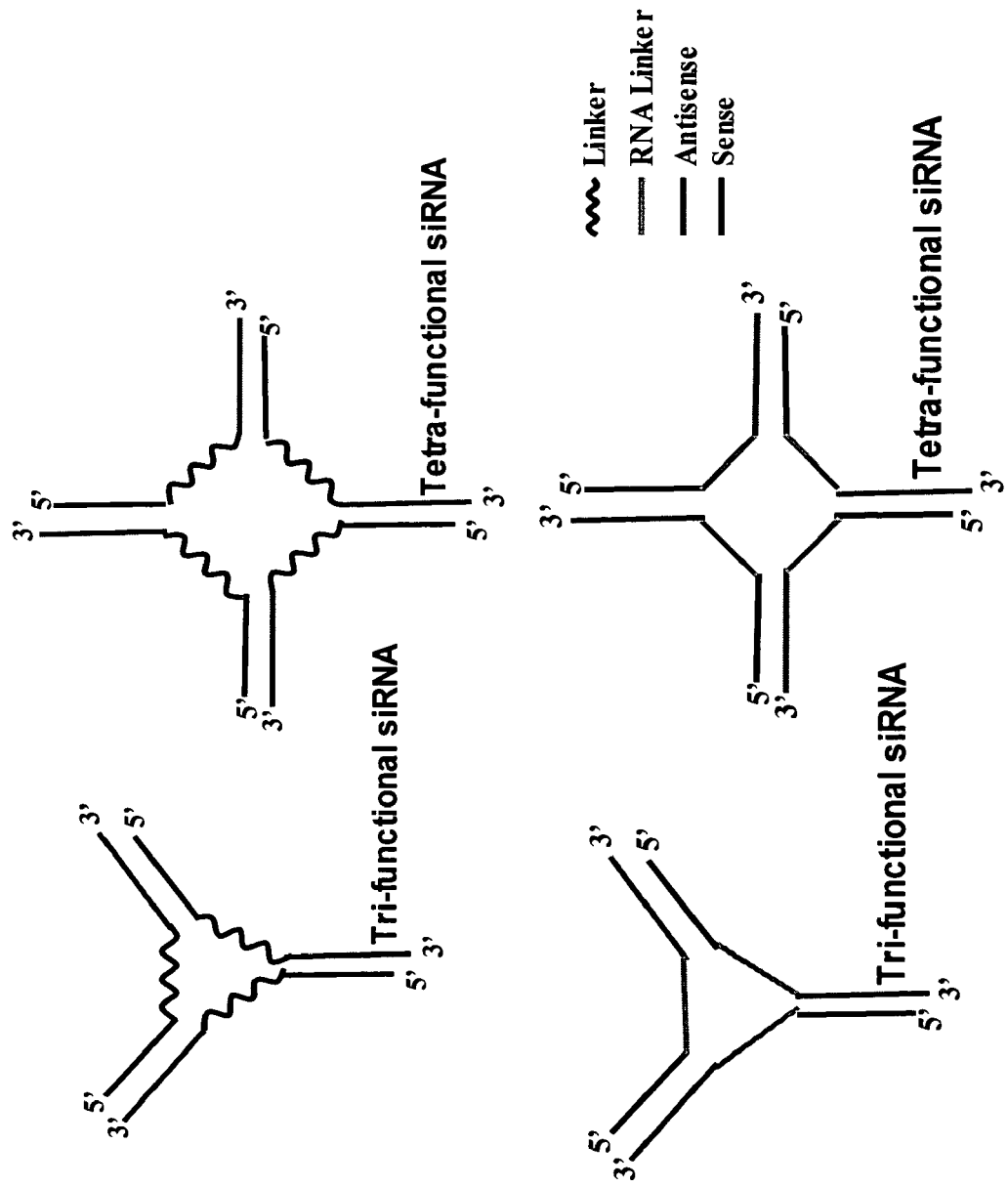
Figure 24: Supramolecular Multifunctional siNA designs

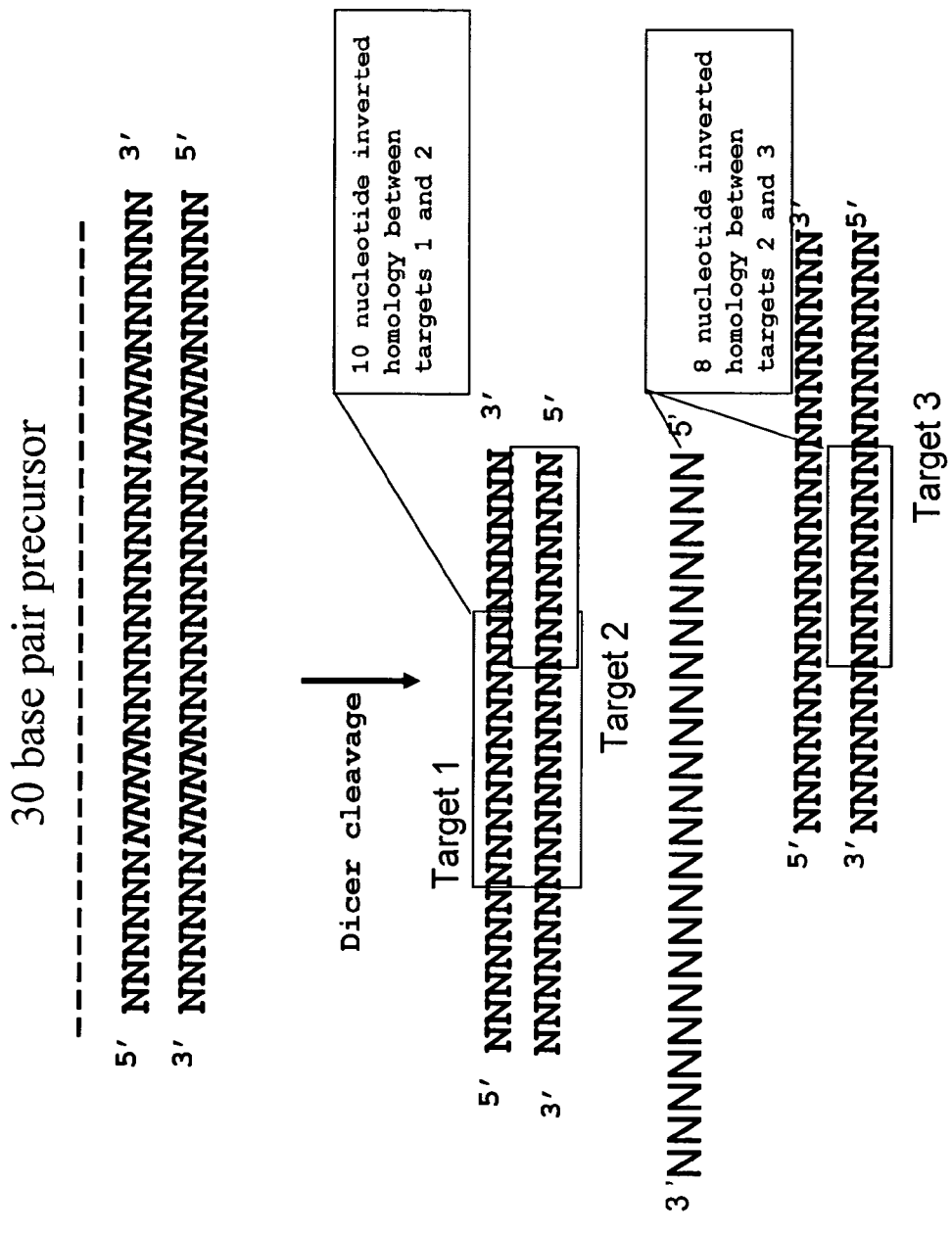
Figure 25: Dicer enabled multifunctional siNA design

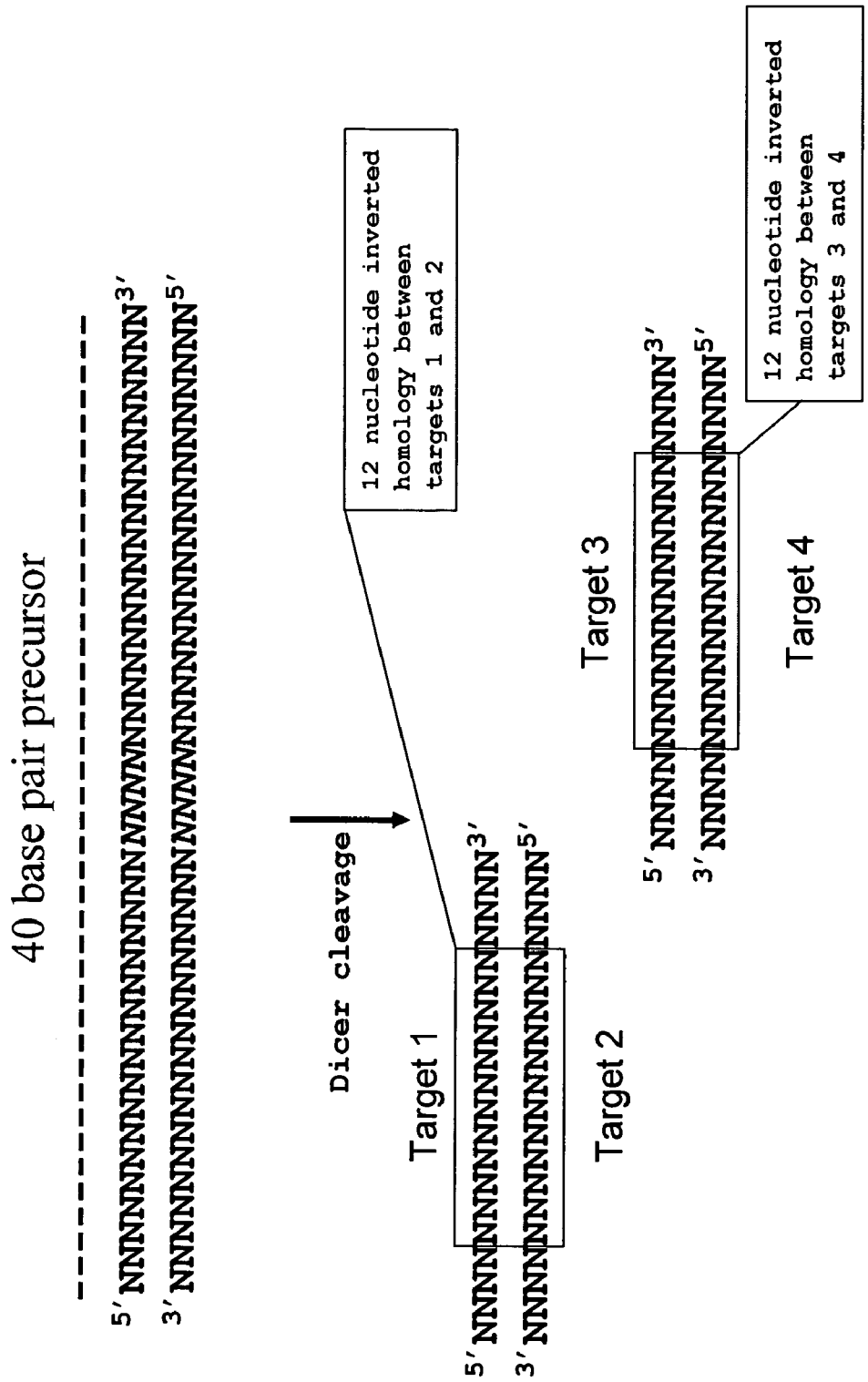
Figure 26: Dicer enabled multifunctional siNA design

*Figure 27: Additional Multifunctional siNA designs*
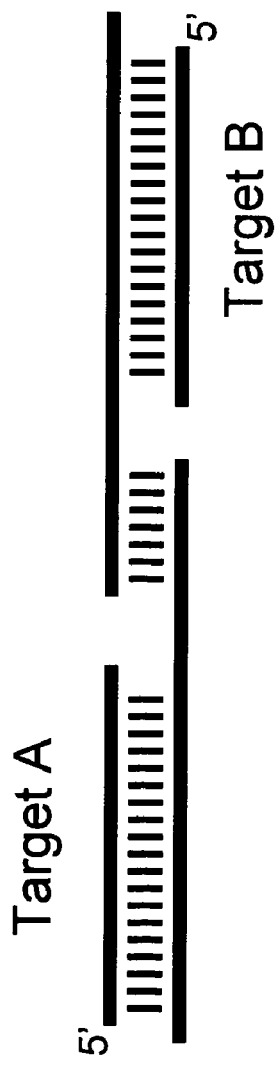
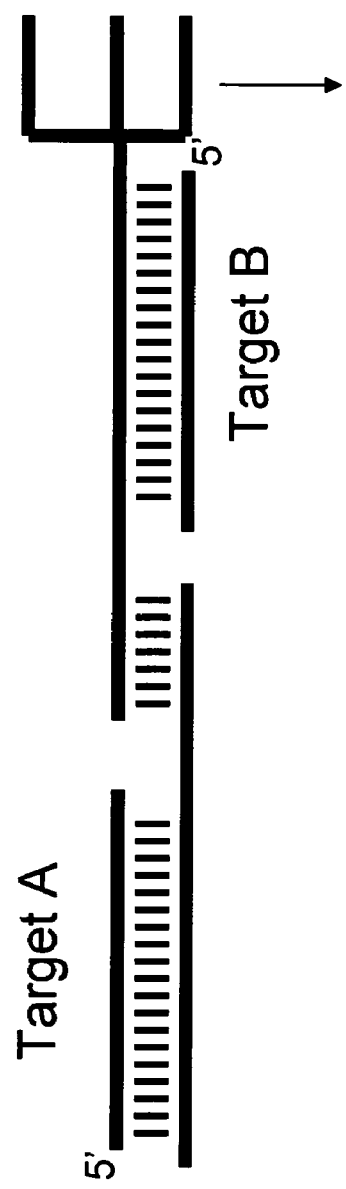
Targeting Ligand/branched Ligand
e.g. Cholesterol, N-acetyl Galactosamine,
Lipid, Peptide, RGD etc.

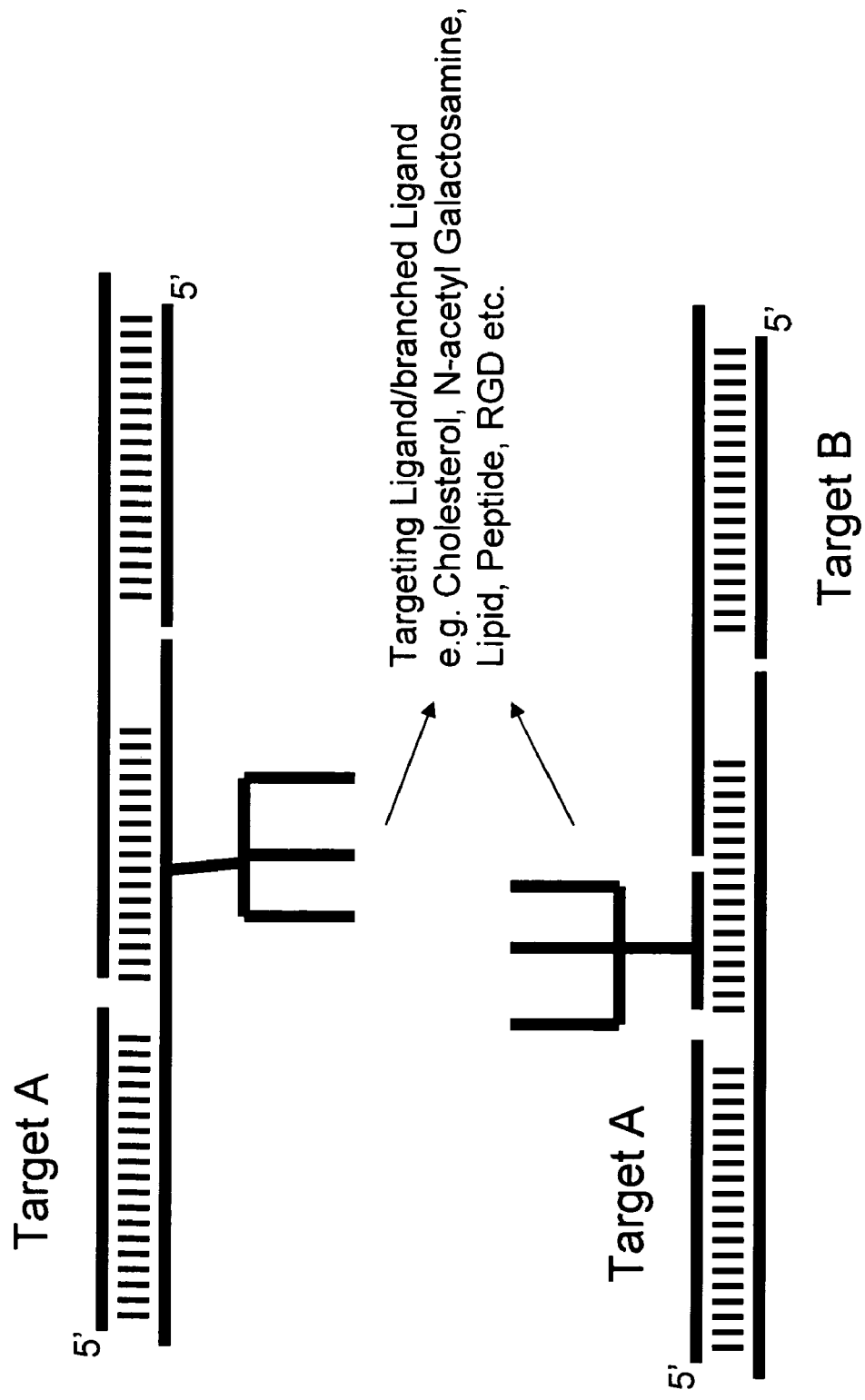
Figure 28: Additional Multifunctional siNA designs

Figure 29: Cholesterol Conjugate Approach
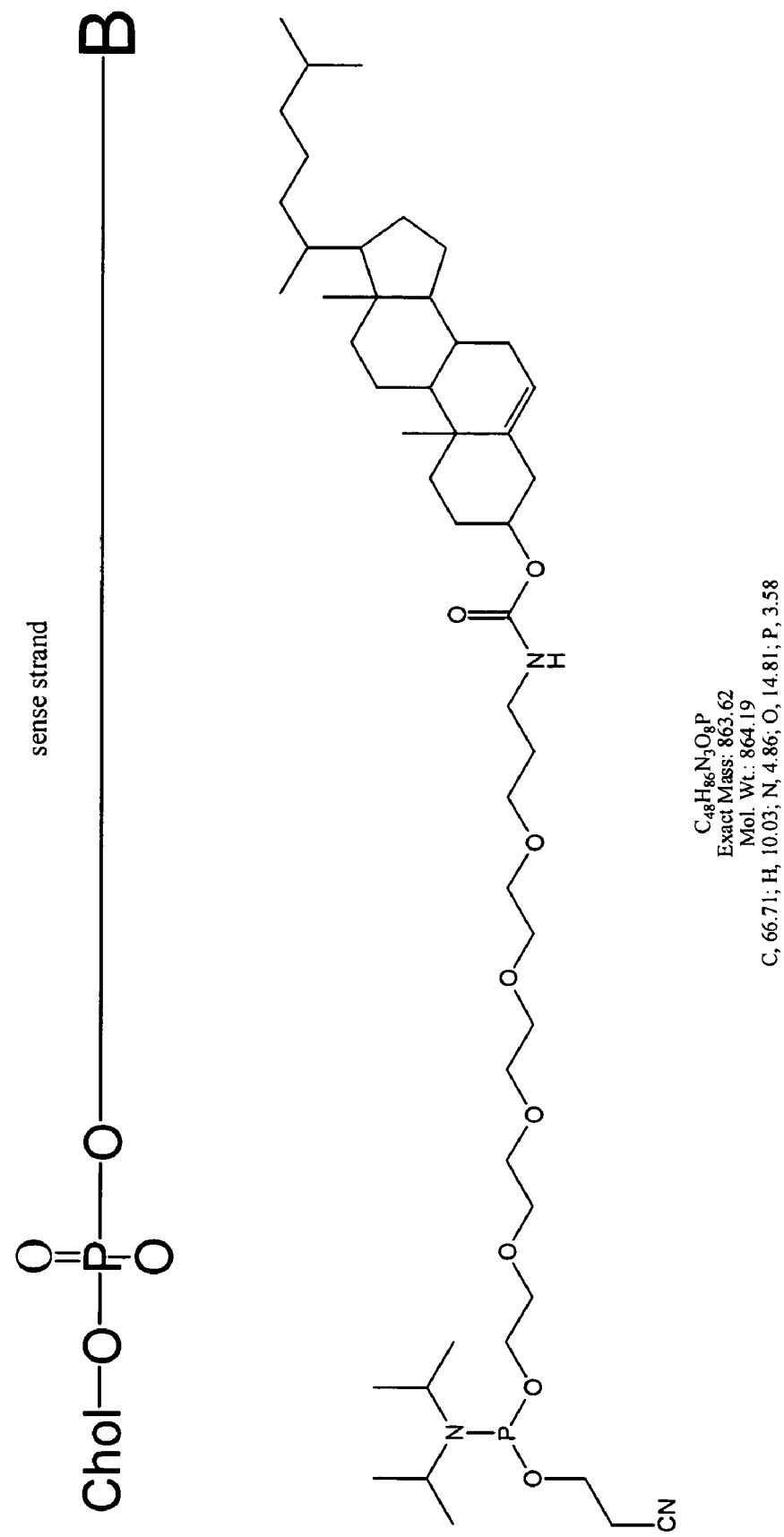

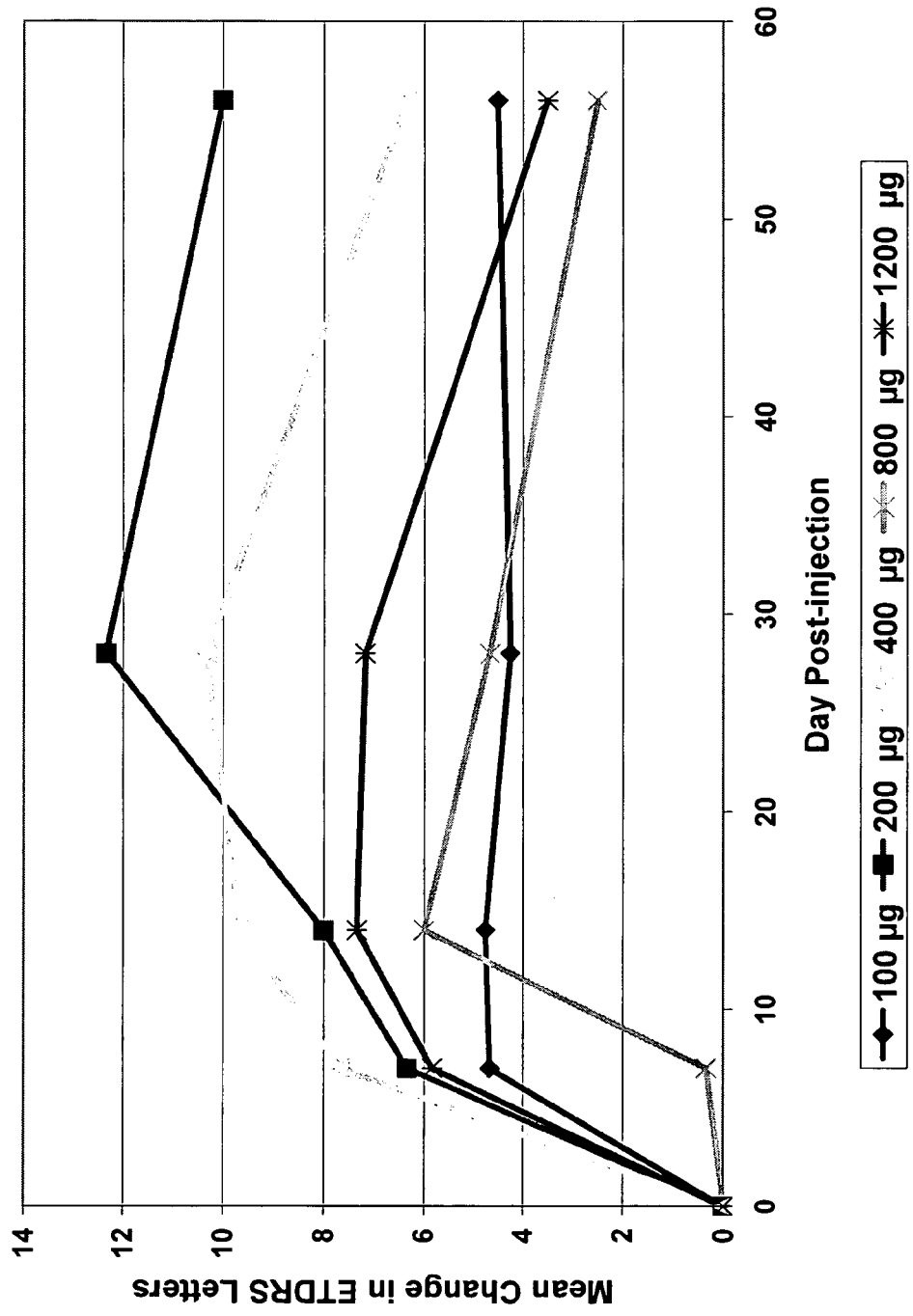
Figure 30: Mean Visual Acuity changes (letters) at 8 weeks post-dosing with Sirna-027

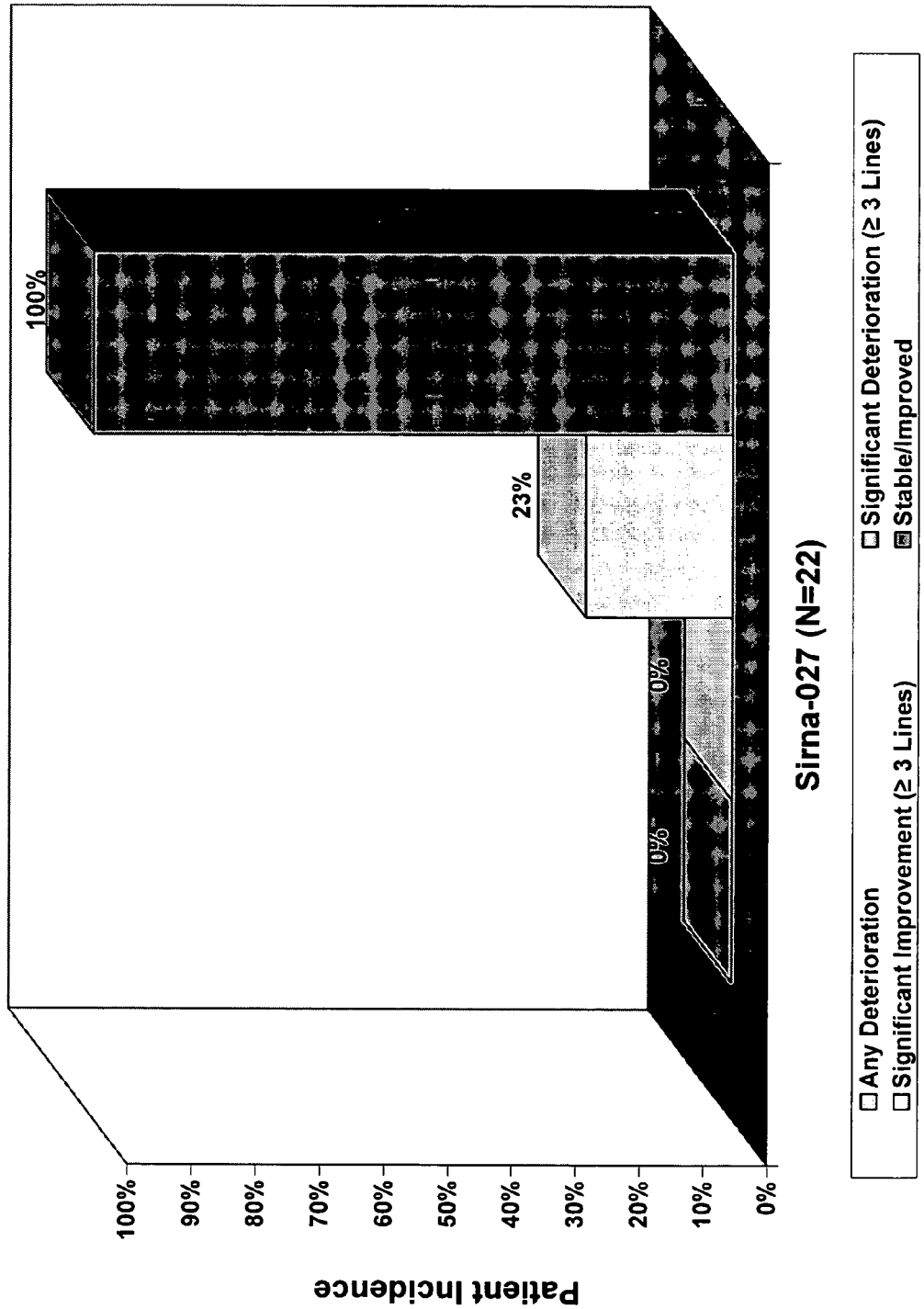
Figure 31: Changes in Patient's Visual Acuity at 8 weeks post-dosing with Sirna-027

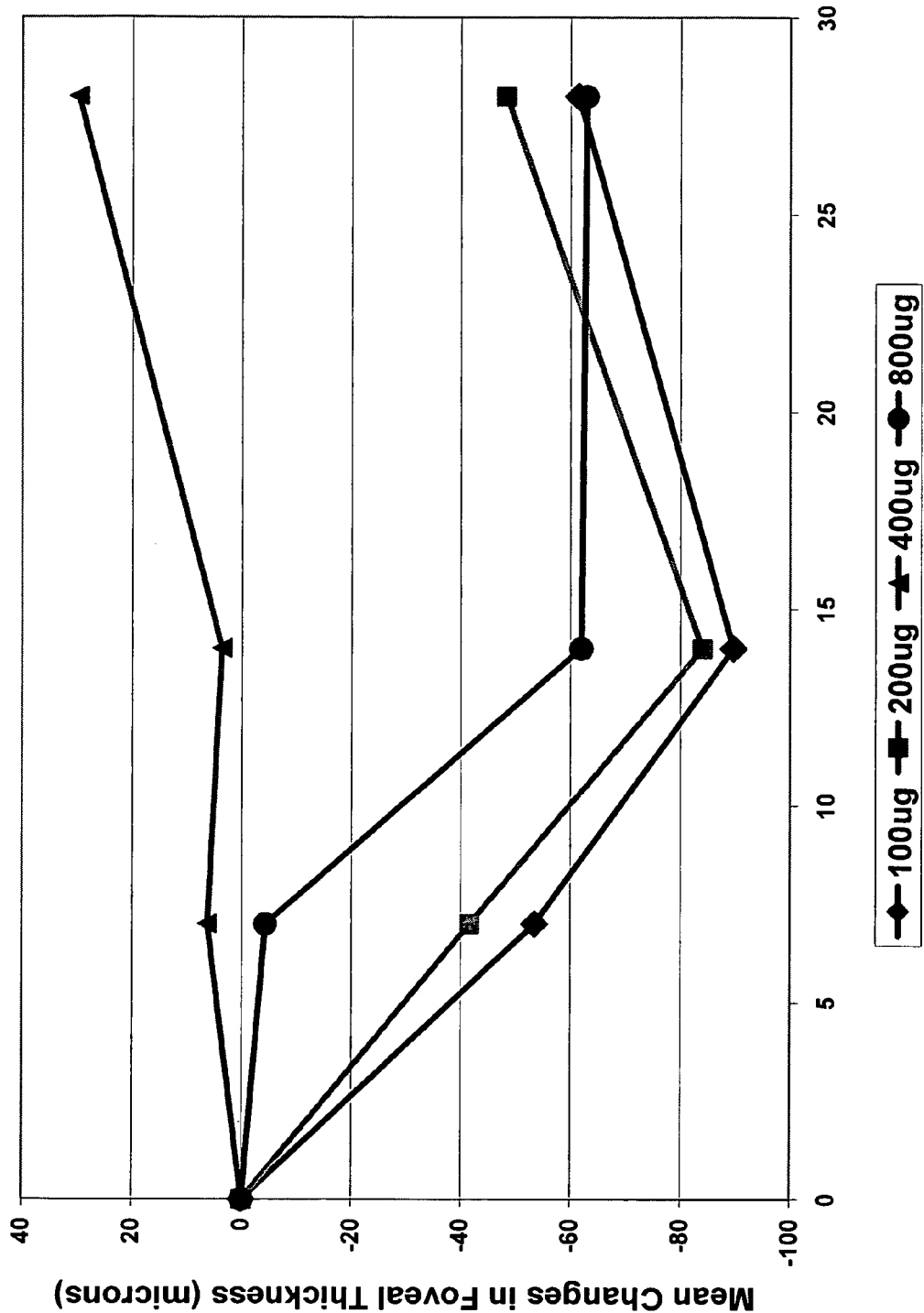
Figure 32: Mean changes in Foveal Thickness post-dosing with Sirna-027

RNA INTERFERENCE MEDIATED INHIBITION OF VASCULAR ENDOTHELIAL GROWTH FACTOR AND VASCULAR ENDOTHELIAL GROWTH FACTOR RECEPTOR GENE EXPRESSION USING SHORT INTERFERING NUCLEIC ACID (SINA)

This application is a continuation-in-part of U.S. patent application Ser. No. 10/962,898, filed Oct. 12, 2004, which is a continuation-in-part of U.S. patent application Ser. No. 10/944,611, filed Sep. 16, 2004, which is a continuation-in-part of U.S. patent application Ser. No. 10/844,076, filed May 11, 2004, which is a continuation-in-part of U.S. patent application Ser. No. 10/831,620, filed Apr. 23, 2004, which is a continuation-in-part of U.S. patent application Ser. No. 10/764,957, filed Jan. 26, 2004, which is a continuation-in-part of U.S. Ser. No. 10/670,011, filed Sep. 23, 2003, which is a continuation-in-part of both U.S. Ser. Nos. 10/665,255 and 10/664,767, filed Sep. 16, 2003, which are continuations-in-part of PCT/US03/05022, filed Feb. 20, 2003, which claims the benefit of U.S. Provisional Application No. 60/393,796 filed Jul. 3, 2002 and claims the benefit of U.S. Provisional Application No. 60/399,348 filed Jul. 29, 2002. This application is also a continuation-in-part of International Patent Application No. PCT/US04/16390, filed May 24, 2004, which is a continuation-in-part of U.S. patent application Ser. No. 10/826,966, filed Apr. 16, 2004, which is continuation-in-part of U.S. patent application Ser. No. 10/757,803, filed Jan. 14, 2004, which is a continuation-in-part of U.S. patent application Ser. No. 10/720,448, filed Nov. 24, 2003, which is a continuation-in-part of U.S. patent application Ser. No. 10/693,059, filed Oct. 23, 2003, which is a continuation-in-part of U.S. patent application Ser. No. 10/444,853, filed May 23, 2003, which is a continuation-in-part of International Patent Application No. PCT/US03/05346, filed Feb. 20, 2003, and a continuation-in-part of International Patent Application No. PCT/US03/05028, filed Feb. 20, 2003, both of which claim the benefit of U.S. Provisional Application No. 60/358,580 filed Feb. 20, 2002, U.S. Provisional Application No. 60/363,124 filed Mar. 11, 2002, U.S. Provisional Application No. 60/386,782 filed Jun. 6, 2002, U.S. Provisional Application No. 60/406,784 filed Aug. 29, 2002, U.S. Provisional Application No. 60/408,378 filed Sep. 5, 2002, U.S. Provisional Application No. 60/409,293 filed Sep. 9, 2002, and U.S. Provisional Application No. 60/440,129 filed Jan. 15, 2003. This application is also a continuation-in-part of International Patent Application No. PCT/US04/13456, filed Apr. 30, 2004, which is a continuation-in-part of U.S. patent application Ser. No. 10/780,447, filed Feb. 13, 2004, which is a continuation-in-part of U.S. patent application No. 10/427,160, filed Apr. 30, 2003, which is a continuation-in-part of International Patent Application No. PCT/US02/15876 filed May 17, 2002, which claims the benefit of U.S. Provisional Application No. 60/292,217, filed May 18, 2001, U.S. Provisional Application No. 60/362,016, filed Mar. 6, 2002, U.S. Provisional Application No. 60/306,883, filed Jul. 20, 2001, and U.S. Provisional Application No. 60/311,865, filed Aug. 13, 2001. This application is also a continuation-in-part of U.S. patent application Ser. No. 10/727,780 filed Dec. 3, 2003. This application is also a continuation-in-part of U.S. patent application Ser. No. 10/922,675 filed Aug. 20, 2004, which is a continuation-in-part of U.S. patent application Ser. No. 10/863,973, filed Jul. 7, 2004, which is a continuation-in-part of International Patent Application No. PCT/US03/04566, filed Feb. 14, 2003. This application also claims the benefit of U.S. Provisional Application No. 60/543,480, filed Feb. 10, 2004. The instant application claims the benefit of all the listed applications, which are hereby incorporated by reference herein in their entireties, including the drawings.

FIELD OF THE INVENTION

The present invention relates to compounds, compositions, and methods for the study, diagnosis, and treatment of traits, diseases and conditions that respond to the modulation of vascular endothelial growth factor (VEGF) and/or vascular endothelial growth factor receptor (e.g., VEGFR1, VEGFR2 and/or VEGFR3, collectively VEGFR) gene expression and/or activity. The present invention is also directed to compounds, compositions, and methods relating to traits, diseases and conditions that respond to the modulation of expression and/or activity of genes involved in vascular endothelial growth factor (VEGF) and/or vascular endothelial growth factor receptor (VEGFR) gene expression pathways or other cellular processes that mediate the maintenance or development of such traits, diseases and conditions. Specifically, the invention relates to small nucleic acid molecules, such as short interfering nucleic acid (siNA), short interfering RNA (siRNA), double-stranded RNA (dsRNA), micro-RNA (miRNA), and short hairpin RNA (shRNA) molecules capable of mediating or that mediate RNA interference (RNAi) against VEGF and/or VEGFR gene expression. Such small nucleic acid molecules are useful, for example, in providing compositions for treatment of traits, diseases and conditions that can respond to modulation of VEGF and/or VEGFR gene expression in a subject or organism, such proliferative diseases and conditions, ocular diseases and conditions, dermatological diseases and conditions, and any other disease, condition, trait or indication that can respond to the level of VEGF and/or VEGFR gene expression in a cell or tissue.

The sequence listing submitted on compact disc, in compliance with 37 C.F.R. § 1.52(e)(5), in incorporated by reference. Two separate compact discs are submitted, each containing the file "02-742-W SeqList.Txt" (1,529,856 bytes in size), each created on CD on Jun. 6, 2006.

BACKGROUND OF THE INVENTION

The following is a discussion of relevant art pertaining to RNAi. The discussion is provided only for understanding of the invention that follows. The summary is not an admission that any of the work described below is prior art to the claimed invention.

RNA interference refers to the process of sequence-specific post-transcriptional gene silencing in animals mediated by short interfering RNAs (siRNAs) (Zamore et al., 2000, Cell, 101, 25-33; Fire et al., 1998, Nature, 391, 806; Hamilton et al., 1999, Science, 286, 950-951; Lin et al., 1999, Nature, 402, 128-129; Sharp, 1999, Genes & Dev., 13:139-141; and Strauss, 1999, Science, 286, 886). The corresponding process in plants (Heifetz et al., International PCT Publication No. WO 99/61631) is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, Trends Genet., 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response through a mechanism that has yet to be fully characterized. This mechanism appears to be different from other known mechanisms involving double stranded RNA-specific ribonucleases, such as the interferon response that results from dsRNA-mediated activation of protein kinase PKR and 2',5'-oligoadenylate synthetase resulting in non-specific cleavage of mRNA by ribonuclease L (see for example U.S. Pat. Nos. 6,107,094; 5,898, 031; Clemens et al., 1997, *J. Interferon & Cytokine Res.*, 17, 503-524; Adah et al., 2001, *Curr. Med. Chem.*, 8, 1189).

The presence of long dsRNAs in cells stimulates the activity of a ribonuclease III enzyme referred to as dicer (Bass, 2000, Cell, 101, 235; Zamore et al., 2000, Cell, 101, 25-33; Hammond et al., 2000, Nature, 404, 293). Dicer is involved in the processing of the dsRNA into short pieces of dsRNA known as short interfering RNAs (siRNAs) (Zamore et al., 2000, Cell, 101, 25-33; Bass, 2000, Cell, 101, 235; Berstein et al., 2001, *Nature*, 409, 363). Short interfering RNAs derived from dicer activity are typically about 21 to about 23 nucleotides in length and comprise about 19 base pair duplexes (Zamore et al., 2000, Cell, 101, 25-33; Elbashir et al., 2001, *Genes Dev.*, 15, 188). Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, *Genes Dev.*, 15, 188).

RNAi has been studied in a variety of systems. Fire et al., 1998, *Nature*, 391, 806, were the first to observe RNAi in *C. elegans*. Bahramian and Zarbl, 1999, *Molecular and Cellular Biology*, 19, 274-283 and Wianny and Goetz, 1999, *Nature Cell Biol.*, 2, 70, describe RNAi mediated by dsRNA in mammalian systems. Hammond et al., 2000, *Nature*, 404, 293, describe RNAi in *Drosophila* cells transfected with dsRNA. Elbashir et al., 2001, *Nature*, 411, 494 and Tuschl et al., International PCT Publication No. WO 01/75164, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, *EMBO J.*, 20, 6877 and Tuschl et al., International PCT Publication No. WO 01/75164) has revealed certain requirements for siRNA length, structure, chemical composition, and sequence that are essential to mediate efficient RNAi activity. These studies have shown that 21-nucleotide siRNA duplexes are most active when containing 3'-terminal dinucleotide overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with 2'-deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end of the guide sequence (Elbashir et al., 2001, *EMBO J.*, 20, 6877). Other studies have indicated that a 5'-phosphate on the target-complementary strand of a siRNA duplex is required for siRNA activity and that ATP is utilized to maintain the 5'-phosphate moiety on the siRNA (Nykanen et al., 2001, *Cell*, 107, 309).

Studies have shown that replacing the 3'-terminal nucleotide overhanging segments of a 21-mer siRNA duplex having two-nucleotide 3'-overhangs with deoxyribonucleotides does not have an adverse effect on RNAi activity. Replacing up to four nucleotides on each end of the siRNA with deoxyribonucleotides has been reported to be well tolerated, whereas complete substitution with deoxyribonucleotides results in no RNAi activity (Elbashir et al., 2001, *EMBO J.*, 20, 6877 and Tuschl et al., International PCT Publication No. WO 01/75164). In addition, Elbashir et al., supra, also report that substitution of siRNA with 2'-O-methyl nucleotides completely abolishes RNAi activity. Li et al., International PCT Publication No. WO 00/44914, and Beach et al., International PCT Publication No. WO 01/68836 preliminarily suggest that siRNA may include modifications to either the phosphate-sugar backbone or the nucleoside to include at least one of a nitrogen or sulfur heteroatom, however, neither application postulates to what extent such modifications would be tolerated in siRNA molecules, nor provides any further guidance or examples of such modified siRNA. Kreutzer et al., Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge. However, Kreutzer et al. similarly fails to provide examples or guidance as to what extent these modifications would be tolerated in dsRNA molecules.

Parrish et al., 2000, *Molecular Cell*, 6, 1077-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl)uracil in the antisense strand resulted in a substantial decrease in RNAi activity as well.

The use of longer dsRNA has been described. For example, Beach et al., International PCT Publication No. WO 01/68836, describes specific methods for attenuating gene expression using endogenously-derived dsRNA. Tuschl et al., International PCT Publication No. WO 01/75164, describe a *Drosophila* in vitro RNAi system and the use of specific siRNA molecules for certain functional genomic and certain therapeutic applications; although Tuschl, 2001, *Chem. Bio-*

*chem.*, 2, 239-245, doubts that RNAi can be used to cure genetic diseases or viral infection due to the danger of activating interferon response. Li et al., International PCT Publication No. WO 00/44914, describe the use of specific long (141 bp-488 bp) enzymatically synthesized or vector expressed dsRNAs for attenuating the expression of certain target genes. Zernicka-Goetz et al., International PCT Publication No. WO 01/36646, describe certain methods for inhibiting the expression of particular genes in mammalian cells using certain long (550 bp-714 bp), enzymatically synthesized or vector expressed dsRNA molecules. Fire et al., International PCT Publication No. WO 99/32619, describe particular methods for introducing certain long dsRNA molecules into cells for use in inhibiting gene expression in nematodes. Plaetinck et al., International PCT Publication No. WO 00/01846, describe certain methods for identifying specific genes responsible for conferring a particular phenotype in a cell using specific long dsRNA molecules. Mello et al., International PCT Publication No. WO 01/29058, describe the identification of specific genes involved in dsRNA-mediated RNAi. Pachuck et al., International PCT Publication No. WO 00/63364, describe certain long (at least 200 nucleotide) dsRNA constructs. Deschamps Depaillette et al., International PCT Publication No. WO 99/07409, describe specific compositions consisting of particular dsRNA molecules combined with certain anti-viral agents. Waterhouse et al., International PCT Publication No. 99/53050 and 1998, *PNAS*, 95, 13959-13964, describe certain methods for decreasing the phenotypic expression of a nucleic acid in plant cells using certain dsRNAs. Driscoll et al., International PCT Publication No. WO 01/49844, describe specific DNA expression constructs for use in facilitating gene silencing in targeted organisms.

Others have reported on various RNAi and gene-silencing systems. For example, Parrish et al., 2000, *Molecular Cell*, 6, 1077-1087, describe specific chemically-modified dsRNA constructs targeting the unc-22 gene of *C. elegans*. Grossniklaus, International PCT Publication No. WO 01/38551, describes certain methods for regulating polycomb gene expression in plants using certain dsRNAs. Churikov et al., International PCT Publication No. WO 01/42443, describe certain methods for modifying genetic characteristics of an organism using certain dsRNAs. Cogoni et al, International PCT Publication No. WO 01/53475, describe certain methods for isolating a *Neurospora* silencing gene and uses thereof. Reed et al., International PCT Publication No. WO 01/68836, describe certain methods for gene silencing in plants. Honer et al., International PCT Publication No. WO 01/70944, describe certain methods of drug screening using transgenic nematodes as Parkinson's Disease models using certain dsRNAs. Deak et al., International PCT Publication No. WO 01/72774, describe certain *Drosophila*-derived gene products that may be related to RNAi in *Drosophila*. Arndt et al., International PCT Publication No. WO 01/92513 describe certain methods for mediating gene suppression by using factors that enhance RNAi. Tuschl et al., International PCT Publication No. WO 02/44321, describe certain synthetic siRNA constructs. Pachuk et al., International PCT Publication No. WO 00/63364, and Satishchandran et al., International PCT Publication No. WO 01/04313, describe certain methods and compositions for inhibiting the function of certain polynucleotide sequences using certain long (over 250 bp), vector expressed dsRNAs. Echeverri et al., International PCT Publication No. WO 02/38805, describe certain *C. elegans* genes identified via RNAi. Kreutzer et al., International PCT Publications Nos. WO 02/055692, WO 02/055693, and EP 1144623 B1 describes certain methods for inhibiting gene expression using dsRNA. Graham et al., International PCT Publications Nos. WO 99/49029 and WO 01/70949, and AU 4037501 describe certain vector expressed siRNA molecules. Fire et al., U.S. Pat. No. 6,506,559, describe certain methods for inhibiting gene expression in vitro using certain long dsRNA (299 bp-1033 bp) constructs that mediate RNAi. Martinez et al., 2002, *Cell*, 110, 563-574, describe certain single stranded siRNA constructs, including certain 5'-phosphorylated single stranded siRNAs that mediate RNA interference in Hela cells. Harborth et al., 2003, Antisense & Nucleic Acid Drug Development, 13, 83-105, describe certain chemically and structurally modified siRNA molecules. Chiu and Rana, 2003, RNA, 9, 1034-1048, describe certain chemically and structurally modified siRNA molecules. Woolf et al., International PCT Publication Nos. WO 03/064626 and WO 03/064625 describe certain chemically modified dsRNA constructs. Hornung et al., 2005, *Nature Medicine*, 11, 263-270, describe the sequence-specific potent induction of IFN-alpha by short interfering RNA in plasmacytoid dendritic cells through TLR7. Judge et al., 2005, Nature Biotechnology, Published online: 20 Mar. 2005, describe the sequence-dependent stimulation of the mammalian innate immune response by synthetic siRNA. Yuki et al., International PCT Publication Nos. WO 05/049821 and WO 04/048566, describe certain methods for designing short interfering RNA sequences and certain short interfering RNA sequences with optimized activity. Saigo et al., US Patent Application Publication No. US20040539332, describe certain methods of designing oligo- or polynucleotide sequences, including short interfering RNA sequences, for achieving RNA interference. Tei et al., International PCT Publication No. WO 03/044188, describe certain methods for inhibiting expression of a target gene, which comprises transfecting a cell, tissue, or individual organism with a double-stranded polynucleotide comprising DNA and RNA having a substantially identical nucleotide sequence with at least a partial nucleotide sequence of the target gene.

SUMMARY OF THE INVENTION

This invention relates to compounds, compositions, and methods useful for modulating the expression of genes, such as those genes associated with angiogenesis and proliferation, using short interfering nucleic acid (siNA) molecules. This invention further relates to compounds, compositions, and methods useful for modulating the expression and activity of vascular endothelial growth factor (VEGF) and/or vascular endothelial growth factor receptor (e.g., VEGFR1, VEGFR2, VEGFR3) genes, or genes involved in VEGF and/or VEGFR pathways of gene expression and/or VEGF activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of VEGF and/or VEGFR genes and/or other genes involved in VEGF and/or VEGFR mediated angiogenesis in a subject or organism.

A siNA of the invention can be unmodified or chemically-modified. A siNA of the instant invention can be chemically synthesized, expressed from a vector or enzymatically synthesized. The instant invention also features various chemically-modified synthetic short interfering nucleic acid (siNA) molecules capable of modulating target gene expression or activity in cells by RNA interference (RNAi). The use of chemically-modified siNA improves various properties of native siNA molecules through increased resistance to nuclease degradation in vivo and/or through improved cellular uptake. Further, contrary to earlier published studies, siNA having multiple chemical modifications retains its RNAi activity. The siNA molecules of the instant invention provide useful reagents and methods for a variety of therapeutic, cosmetic, veterinary, diagnostic, target validation, genomic discovery, genetic engineering, and pharmacogenomic applications.

In one embodiment, the invention features one or more siNA molecules and methods that independently or in combination modulate the expression of VEGF and/or VEGFR target genes, such as genes that are associated with the maintenance and/or development of inflammatory diseases and conditions, respiratory diseases and conditions, allergic diseases and conditions, autoimmune diseases and conditions, neurologic diseases and conditions, ocular diseases and conditions, and cancer and other proliferative diseases and conditions, such as genes encoding sequences comprising those sequences referred to by GenBank Accession Nos. shown in Table I, referred to herein generally as VEGF and/or VEGFR, and also those sequences referred to by GenBank Accession Nos. shown in U.S. Ser. Nos. 10/923,536 and 10/923,536, both incorporated by reference herein, referred to herein generally as "target" sequences. The description below of the various aspects and embodiments of the invention is provided with reference to the exemplary VEGF (e.g., VEGF, VEGF-A, VEGF-B, VEGF-C, VEGF-D) and VEGFR (e.g., VEGFR1, VEGFR2, VEGFR3) genes referred to herein as VEGF and VEGFR respectively. However, the various aspects and embodiments are also directed to other genes, such as VEGF and/or VEGFR gene homologs, transcript variants, and polymorphisms (e.g., single nucleotide polymorphism, (SNPs)) associated with certain VEGF and/or VEGFR genes. The various aspects and embodiments are also directed to other genes that are involved in VEGF and/or VEGFR mediated pathways of signal transduction or gene expression that are involved in the progression, development, and/or maintenance of disease (e.g., cancer, inflammatory disease, allergic disease, autoimmune disease, ocular disease, or other angiogenesis/neovascularization related diseases and conditions), such as interleukins, including for example IL-4, IL-4 receptor, IL-13, and IL-13 receptor. These additional genes can be analyzed for target sites using the methods described for VEGF and/or VEGFR genes herein. Thus, the modulation of other genes and the effects of such modulation of the other genes can be performed, determined, and measured as described herein.

In one embodiment, the invention features a double stranded nucleic acid molecule, such as an siNA molecule, where one of the strands comprises nucleotide sequence having complementarity to a predetermined nucleotide sequence in a target nucleic acid molecule, or a portion thereof. In one embodiment, the predetermined nucleotide sequence is a nucleotide target sequence described herein. In another embodiment, the predetermined nucleotide sequence is a target sequence as is known in the art.

In one embodiment, the invention features a double-stranded short interfering nucleic acid (siNA) molecule that down-regulates expression of a target gene or that directs cleavage of a target RNA, wherein said siNA molecule comprises about 15 to about 28 base pairs.

In one embodiment, the invention features a double-stranded short interfering nucleic acid (siNA) molecule that directs cleavage of a target RNA, wherein said siNA molecule comprises about 15 to about 28 base pairs.

In one embodiment, the invention features a double stranded short interfering nucleic acid (siNA) molecule that directs cleavage of a target RNA via RNA interference (RNAi), wherein the double stranded siNA molecule comprises a first and a second strand, each strand of the siNA molecule is about 18 to about 28 nucleotides in length, the first strand of the siNA molecule comprises nucleotide sequence having sufficient complementarity to the target RNA for the siNA molecule to direct cleavage of the target RNA via RNA interference, and the second strand of said siNA molecule comprises nucleotide sequence that is complementary to the first strand.

In one embodiment, the invention features a double stranded short interfering nucleic acid (siNA) molecule that directs cleavage of a target RNA via RNA interference (RNAi), wherein the double stranded siNA molecule comprises a first and a second strand, each strand of the siNA molecule is about 18 to about 23 nucleotides in length, the first strand of the siNA molecule comprises nucleotide sequence having sufficient complementarity to the target RNA for the siNA molecule to direct cleavage of the target RNA via RNA interference, and the second strand of said siNA molecule comprises nucleotide sequence that is complementary to the first strand.

In one embodiment, the invention features a chemically synthesized double stranded short interfering nucleic acid (siNA) molecule that directs cleavage of a target RNA via RNA interference (RNAi), wherein each strand of the siNA molecule is about 18 to about 28 nucleotides in length; and one strand of the siNA molecule comprises nucleotide sequence having sufficient complementarity to the target RNA for the siNA molecule to direct cleavage of the target RNA via RNA interference.

In one embodiment, the invention features a chemically synthesized double stranded short interfering nucleic acid (siNA) molecule that directs cleavage of a target RNA via RNA interference (RNAi), wherein each strand of the siNA molecule is about 18 to about 23 nucleotides in length; and one strand of the siNA molecule comprises nucleotide sequence having sufficient complementarity to the target RNA for the siNA molecule to direct cleavage of the target RNA via RNA interference.

In one embodiment, the invention features a siNA molecule that down-regulates expression of a target gene or that directs cleavage of a target RNA, for example, wherein the target gene or RNA comprises protein encoding sequence. In one embodiment, the invention features a siNA molecule that down-regulates expression of a target gene or that directs cleavage of a target RNA, for examples wherein the target gene or RNA comprises non-coding sequence or regulatory elements involved in target gene expression (e.g., non-coding RNA).

In one embodiment, a siNA of the invention is used to inhibit the expression of VEGF and/or VEGFR genes or a VEGF and/or VEGFR gene family (e.g., one or more VEGF and/or VEGFR isoforms), wherein the genes or gene family sequences share sequence homology. Such homologous sequences can be identified as is known in the art, for example using sequence alignments. siNA molecules can be designed to target such homologous sequences, for example using perfectly complementary sequences or by incorporating non-canonical base pairs, for example mismatches and/or wobble base pairs, that can provide additional target sequences. In instances where mismatches are identified, non-canonical base pairs (for example, mismatches and/or wobble bases) can be used to generate siNA molecules that target more than one gene sequence. In a non-limiting example, non-canonical base pairs such as UU and CC base pairs are used to generate siNA molecules that are capable of targeting sequences for differing polynucleotide targets that share sequence homology. As such, one advantage of using siNAs of the invention is that a single siNA can be designed to include nucleic acid sequence that is complementary to the nucleotide sequence that is conserved between the homologous genes. In this approach, a single siNA can be used to inhibit expression of more than one gene instead of using more than one siNA molecule to target the different genes.

In one embodiment, the invention features a siNA molecule having RNAi activity against target RNA (e.g., coding or non-coding RNA), wherein the siNA molecule comprises a sequence complementary to any RNA sequence, such as those sequences having GenBank Accession Nos. shown in GenBank Accession Nos. shown in Table I and in U.S. Ser. Nos. 10/923,536 and 10/923,536, both incorporated by reference herein. In another embodiment, the invention features a siNA molecule having RNAi activity against target RNA, wherein the siNA molecule comprises a sequence complementary to an RNA having variant encoding sequence, for example other mutant genes known in the art to be associated with the maintenance and/or development of diseases, traits, disorders, and/or conditions described herein or otherwise known in the art. Chemical modifications as shown in Tables III and IV or otherwise described herein can be applied to any siNA construct of the invention. In another embodiment, a siNA molecule of the invention includes a nucleotide sequence that can interact with nucleotide sequence of a target gene and thereby mediate silencing of target gene expression, for example, wherein the siNA mediates regulation of target gene expression by cellular processes that modulate the chromatin structure or methylation patterns of the target gene and prevent transcription of the target gene.

In one embodiment, the invention features a siNA molecule having RNAi activity against VEGF and/or VEGFR RNA, wherein the siNA molecule comprises a sequence complementary to any RNA having VEGF and/or VEGFR encoding sequence, such as those sequences having VEGF and/or VEGFR GenBank Accession Nos. shown in Table I. In another embodiment, the invention features a siNA molecule having RNAi activity against VEGF and/or VEGFR RNA, wherein the siNA molecule comprises a sequence complementary to an RNA having other VEGF and/or VEGFR encoding sequence, for example, mutant VEGF and/or VEGFR genes, splice variants of VEGF and/or VEGFR genes, VEGF and/or VEGFR variants with conservative substitutions, and homologous VEGF and/or VEGFR ligands and receptors. Chemical modifications as shown in Tables III and IV or otherwise described herein can be applied to any siNA construct of the invention.

In one embodiment, siNA molecules of the invention are used to down regulate or inhibit the expression of proteins arising from VEGF and/or VEGFR haplotype polymorphisms that are associated with a trait, disease or condition. Analysis of genes, or protein or RNA levels can be used to identify subjects with such polymorphisms or those subjects who are at risk of developing traits, conditions, or diseases described herein (see for example Silvestri et al., 2003, Int J Cancer., 104, 310-7). These subjects are amenable to treatment, for example, treatment with siNA molecules of the invention and any other composition useful in treating diseases related to VEGF and/or VEGFR gene expression. As such, analysis of VEGF and/or VEGFR protein or RNA levels can be used to determine treatment type and the course of therapy in treating a subject. Monitoring of VEGF and/or VEGFR protein or RNA levels can be used to predict treatment outcome and to determine the efficacy of compounds and compositions that modulate the level and/or activity of certain VEGF and/or VEGFR proteins associated with a trait, condition, or disease.

In one embodiment, siNA molecules of the invention are used to down regulate or inhibit the expression of soluble VEGF receptors (e.g. sVEGFR1 or sVEGFR2). Analysis of soluble VEGF receptor levels can be used to identify subjects with certain cancer types. These cancers can be amenable to treatment, for example, treatment with siNA molecules of the invention and any other chemotherapeutic composition. As such, analysis of soluble VEGF receptor levels can be used to determine treatment type and the course of therapy in treating a subject. Monitoring of soluble VEGF receptor levels can be used to predict treatment outcome and to determine the efficacy of compounds and compositions that modulate the level and/or activity of VEGF receptors (see for example Pavco U.S. Ser. No. 10/438,493, incorporated by reference herein in its entirety including the drawings).

In one embodiment of the invention a siNA molecule comprises an antisense strand comprising a nucleotide sequence that is complementary to a nucleotide sequence or a portion thereof encoding a target VEGF and/or VEGFR protein. The siNA further comprises a sense strand, wherein said sense strand comprises a nucleotide sequence of a target VEGF and/or VEGFR gene or a portion thereof.

In another embodiment, a siNA molecule comprises an antisense region comprising a nucleotide sequence that is complementary to a nucleotide sequence encoding a target VEGF and/or VEGFR protein or a portion thereof. The siNA molecule further comprises a sense region, wherein said sense region comprises a nucleotide sequence of a target VEGF and/or VEGFR gene or a portion thereof.

In another embodiment, the invention features a siNA molecule comprising nucleotide sequence, for example, nucleotide sequence in the antisense region of the siNA molecule that is complementary to a nucleotide sequence or portion of sequence of a target VEGF and/or VEGFR gene. In another embodiment, the invention features a siNA molecule comprising a region, for example, the antisense region of the siNA construct, complementary to a sequence comprising a target VEGF and/or VEGFR gene sequence or a portion thereof.

In one embodiment, the sense region or sense strand of a siNA molecule of the invention is complementary to that portion of the antisense region or antisense strand of the siNA molecule that is complementary to a target VEGF and/or VEGFR polynucleotide sequence.

In yet another embodiment, the invention features a siNA molecule comprising a sequence, for example, the antisense sequence of the siNA construct, complementary to a sequence or portion of sequence comprising sequence represented by GenBank Accession Nos. shown in U.S. Ser. Nos. 10/923,536 and 10/923,536, both incorporated by reference herein. Chemical modifications in Table I and otherwise described herein can be applied to any siNA construct of the invention.

In one embodiment of the invention a siNA molecule comprises an antisense strand having about 15 to about 30 (e.g., about 15, 16, 17, 18, 19, 20, 21, 22, 23, 24, 25, 26, 27, 28, 29, or 30) nucleotides, wherein the antisense strand is complementary to a target VEGF and/or VEGFR RNA sequence or a portion thereof, and wherein said siNA further comprises a sense strand having about 15 to about 30 (e.g., about 15, 16, 17, 18, 19, 20, 21, 22, 23, 24, 25, 26, 27, 28, 29, or 30) nucleotides, and wherein said sense strand and said antisense strand are distinct nucleotide sequences where at least about 15 nucleotides in each strand are complementary to the other strand.

In another embodiment of the invention a siNA molecule of the invention comprises an antisense region having about 15 to about 30 (e.g., about 15, 16, 17, 18, 19, 20, 21, 22, 23, 24, 25, 26, 27, 28, 29, or 30) nucleotides, wherein the antisense region is complementary to a target VEGF and/or VEGFR DNA sequence, and wherein said siNA further comprises a sense region having about 15 to about 30 (e.g., about 15, 16, 17, 18, 19, 20, 21, 22, 23, 24, 25, 26, 27, 28, 29, or 30) nucleotides, wherein said sense region and said antisense region are comprised in a linear molecule where the sense region comprises at least about 15 nucleotides that are complementary to the antisense region.

In one embodiment, a siNA molecule of the invention has RNAi activity that modulates expression of RNA encoded by one or more genes. Because various genes can share some degree of sequence homology with each other, siNA molecules can be designed to target a class of genes or alternately specific genes (e.g., polymorphic variants) by selecting sequences that are either shared amongst different gene target VEGF and/or VEGFRs or alternatively that are unique for a specific gene target VEGF and/or VEGFR. Therefore, in one embodiment, the siNA molecule can be designed to target conserved regions of target VEGF and/or VEGFR RNA sequences having homology among several gene variants so as to target a class of genes with one siNA molecule. Accordingly, in one embodiment, the siNA molecule of the invention modulates the expression of one or both gene alleles in a subject. In another embodiment, the siNA molecule can be designed to target a sequence that is unique to a specific target VEGF and/or VEGFR RNA sequence (e.g., a single allele or single nucleotide polymorphism (SNP)) due to the high degree of specificity that the siNA molecule requires to mediate RNAi activity.

In one embodiment, nucleic acid molecules of the invention that act as mediators of the RNA interference gene silencing response are double-stranded nucleic acid molecules. In another embodiment, the siNA molecules of the invention consist of duplex nucleic acid molecules containing about 15 to about 30 base pairs between oligonucleotides comprising about 15 to about 30 (e.g., about 15, 16, 17, 18, 19, 20, 21, 22, 23, 24, 25, 26, 27, 28, 29, or 30) nucleotides. In yet another embodiment, siNA molecules of the invention comprise duplex nucleic acid molecules with overhanging ends of about 1 to about 3 (e.g., about 1, 2, or 3) nucleotides, for example, about 21-nucleotide duplexes with about 19 base pairs and 3'-terminal mononucleotide, dinucleotide, or trinucleotide overhangs. In yet another embodiment, siNA molecules of the invention comprise duplex nucleic acid molecules with blunt ends, where both ends are blunt, or alternatively, where one of the ends is blunt.

In one embodiment, a double stranded nucleic acid (e.g., siNA) molecule comprises nucleotide or non-nucleotide overhangs. By "overhang" is meant a terminal portion of the nucleotide sequence that is not base paired between the two strands of a double stranded nucleic acid molecule (see for example FIG. 6). In one embodiment, a double stranded nucleic acid molecule of the invention can comprise nucleotide or non-nucleotide overhangs at the 3'-end of one or both strands of the double stranded nucleic acid molecule. For example, a double stranded nucleic acid molecule of the invention can comprise a nucleotide or non-nucleotide overhang at the 3'-end of the guide strand or antisense strand/region, the 3'-end of the passenger strand or sense strand/region, or both the guide strand or antisense strand/region and the passenger strand or sense strand/region of the double stranded nucleic acid molecule. In another embodiment, the nucleotide overhang portion of a double stranded nucleic acid (siNA) molecule of the invention comprises 2'-O-methyl, 2'-deoxy, 2'-deoxy-2'-fluoro, 4'-thio, 2'-O-trifluoromethyl, 2'-O-ethyl-trifluoromethoxy, 2'-O-difluoromethoxy-ethoxy, universal base, acyclic, or 5-C-methyl nucleotides. In another embodiment, the non-nucleotide overhang portion of a double stranded nucleic acid (siNA) molecule of the invention comprises glyceryl, abasic, or inverted deoxy abasic non-nucleotides.

In one embodiment, the nucleotides comprising the overhang portions of a double stranded nucleic acid (e.g., siNA) molecule of the invention correspond to the nucleotides comprising the target VEGF and/or VEGFR polynucleotide sequence of the siNA molecule. Accordingly, in such embodiments, the nucleotides comprising the overhang portion of a siNA molecule of the invention comprise sequence based on the target VEGF and/or VEGFR polynucleotide sequence in which nucleotides comprising the overhang portion of the guide strand or antisense strand/region of a siNA molecule of the invention can be complementary to nucleotides in the target VEGF and/or VEGFR polynucleotide sequence and nucleotides comprising the overhang portion of the passenger strand or sense strand/region of a siNA molecule of the invention can comprise the nucleotides in the target VEGF and/or VEGFR polynucleotide sequence. Such nucleotide overhangs comprise sequence that would result from Dicer processing of a native dsRNA into siRNA.

In one embodiment, the nucleotides comprising the overhang portion of a double stranded nucleic acid (e.g., siNA) molecule of the invention are complementary to the target VEGF and/or VEGFR polynucleotide sequence and are optionally chemically modified as described herein. As such, in one embodiment, the nucleotides comprising the overhang portion of the guide strand or antisense strand/region of a siNA molecule of the invention can be complementary to nucleotides in the target VEGF and/or VEGFR polynucleotide sequence, i.e. those nucleotide positions in the target VEGF and/or VEGFR polynucleotide sequence that are complementary to the nucleotide positions of the overhang nucleotides in the guide strand or antisense strand/region of a siNA molecule. In another embodiment, the nucleotides comprising the overhang portion of the passenger strand or sense strand/region of a siNA molecule of the invention can comprise the nucleotides in the target VEGF and/or VEGFR polynucleotide sequence, i.e. those nucleotide positions in the target VEGF and/or VEGFR polynucleotide sequence that correspond to same the nucleotide positions of the overhang nucleotides in the passenger strand or sense strand/region of a siNA molecule. In one embodiment, the overhang comprises a two nucleotide (e.g., 3'-GA; 3'-GU; 3'-GG; 3'GC; 3'-CA; 3'-CU; 3'-CG; 3'CC; 3'-UA; 3'-UU; 3'-UG; 3'UC; 3'-AA; 3'-AU; 3'-AG; 3'-AC; 3'-TA; 3'-TU; 3'-TG; 3'-TC; 3'-AT; 3'-UT; 3'-GT; 3'-CT) overhang that is complementary to a portion of the target VEGF and/or VEGFR polynucleotide sequence. In one embodiment, the overhang comprises a two nucleotide (e.g., 3'-GA; 3'-GU; 3'-GG; 3'GC; 3'-CA; 3'-CU; 3'-CG; 3'CC; 3'-UA; 3'-UU; 3'-UG; 3'UC; 3'-AA; 3'-AU; 3'-AG; 3'-AC; 3'-TA; 3'-TU; 3'-TG; 3'-TC; 3'-AT; 3'-UT; 3'-GT; 3'-CT) overhang that is not complementary to a portion of the target VEGF and/or VEGFR polynucleotide sequence. In another embodiment, the overhang nucleotides of a siNA molecule of the invention are 2'-O-methyl nucleotides and/or 2'-deoxy-2'-fluoro nucleotides. In another embodiment, the overhang nucleotides of a siNA molecule of the invention are 2'-O-methyl nucleotides in the event the overhang nucleotides are purine nucleotides and/or 2'-deoxy-2'-fluoro nucleotides in the event the overhang nucleotides are pyrimidines nucleotides. In another embodiment, the purine nucleotide (when present) in an overhang of siNA molecule of the invention is 2'-O-methyl nucleotides. In another embodiment, the pyrimidine nucleotide (when present) in an overhang of siNA molecule of the invention is 2'-deoxy-2'-fluoro nucleotides nucleotide.

In one embodiment, the nucleotides comprising the overhang portion of a double stranded nucleic acid (e.g., siNA) molecule of the invention are not complementary to the target VEGF and/or VEGFR polynucleotide sequence and are optionally chemically modified as described herein. In one embodiment, the overhang comprises a 3'-UU overhang that is not complementary to a portion of the target VEGF and/or VEGFR polynucleotide sequence. In another embodiment, the nucleotides comprising the overhanging portion of a siNA molecule of the invention are 2'-O-methyl nucleotides and/or 2'-deoxy-2'-fluoro nucleotides.

In one embodiment, the double stranded nucleic molecule (e.g. siNA) of the invention comprises a two or three nucleotide overhang, wherein the nucleotides in the overhang are same or different. In one embodiment, the double stranded nucleic molecule (e.g. siNA) of the invention comprises a two or three nucleotide overhang, wherein the nucleotides in the overhang are the same or different and wherein one or more nucleotides in the overhang are chemically modified at the base, sugar and/or phosphate backbone.

In one embodiment, the invention features one or more chemically-modified siNA constructs having specificity for target VEGF and/or VEGFR nucleic acid molecules, such as DNA, or RNA encoding a protein or non-coding RNA associated with the expression of target VEGF and/or VEGFR genes. In one embodiment, the invention features a RNA based siNA molecule (e.g., a siNA comprising 2'-OH nucleotides) having specificity for nucleic acid molecules that includes one or more chemical modifications described herein. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides (see for example U.S. Ser. No. 10/981,966 filed Nov. 5, 2004, incorporated by reference herein), "universal base" nucleotides, "acyclic" nucleotides, 5-C-methyl nucleotides, and terminal glyceryl and/or inverted deoxy abasic residue incorporation. These chemical modifications, when used in various siNA constructs, (e.g., RNA based siNA constructs), are shown to preserve RNAi activity in cells while at the same time, dramatically increasing the serum stability of these compounds. Furthermore, contrary to the data published by Parrish et al., supra, applicant demonstrates that multiple (greater than one) phosphorothioate substitutions are well-tolerated and confer substantial increases in serum stability for modified siNA constructs.

In one embodiment, a siNA molecule of the invention comprises modified nucleotides while maintaining the ability to mediate RNAi. The modified nucleotides can be used to improve in vitro or in vivo characteristics such as stability, activity, toxicity, immune response, and/or bioavailability. For example, a siNA molecule of the invention can comprise modified nucleotides as a percentage of the total number of nucleotides present in the siNA molecule. As such, a siNA molecule of the invention can generally comprise about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). For example, in one embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid sugar modification, such as a 2'-sugar modification, e.g., 2'-O-methyl nucleotides, 2'-deoxy-2'-fluoro nucleotides, 2'-O-methoxyethyl nucleotides, 2'-O-trifluoromethyl nucleotides, 2'-O-ethyl-trifluoromethoxy nucleotides, 2'-O-difluoromethoxy-ethoxy nucleotides, or 2'-deoxy nucleotides. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid base modification, such as inosine, purine, pyridin-4-one, pyridin-2-one, phenyl, pseudouracil, 2, 4, 6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), or propyne modifications. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid backbone modification, such as a backbone modification having Formula I herein. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid sugar, base, or backbone modification or any combination thereof (e.g., any combination of nucleic acid sugar, base, backbone or non-nucleotide modifications herein). The actual percentage of modified nucleotides present in a given siNA molecule will depend on the total number of nucleotides present in the siNA. If the siNA molecule is single stranded, the percent modification can be based upon the total number of nucleotides present in the single stranded siNA molecules. Likewise, if the siNA molecule is double stranded, the percent modification can be based upon the total number of nucleotides present in the sense strand, antisense strand, or both the sense and antisense strands.

A siNA molecule of the invention can comprise modified nucleotides at various locations within the siNA molecule. In one embodiment, a double stranded siNA molecule of the invention comprises modified nucleotides at internal base paired positions within the siNA duplex. For example, internal positions can comprise positions from about 3 to about 19 nucleotides from the 5'-end of either sense or antisense strand or region of a 21 nucleotide siNA duplex having 19 base pairs and two nucleotide 3'-overhangs. In another embodiment, a double stranded siNA molecule of the invention comprises modified nucleotides at non-base paired or overhang regions of the siNA molecule. By "non-base paired" is meant, the nucleotides are not base paired between the sense strand or sense region and the antisense strand or antisense region or the siNA molecule. The overhang nucleotides can be complementary or base paired to a corresponding target VEGF and/or VEGFR polynucleotide sequence (see for example FIG. 6C). For example, overhang positions can comprise positions from about 20 to about 21 nucleotides from the 5'-end of either sense or antisense strand or region of a 21 nucleotide siNA duplex having 19 base pairs and two nucleotide 3'-overhangs. In another embodiment, a double stranded siNA molecule of the invention comprises modified nucleotides at terminal positions of the siNA molecule. For example, such terminal regions include the 3'-position, 5'-position, for both 3' and 5'-positions of the sense and/or antisense strand or region of the siNA molecule. In another embodiment, a double stranded siNA molecule of the invention comprises modified nucleotides at base-paired or internal positions, non-base paired or overhang regions, and/or terminal regions, or any combination thereof.

One aspect of the invention features a double-stranded short interfering nucleic acid (siNA) molecule that down-regulates expression of a target VEGF and/or VEGFR gene or that directs cleavage of a target VEGF and/or VEGFR RNA. In one embodiment, the double stranded siNA molecule comprises one or more chemical modifications and each strand of the double-stranded siNA is about 21 nucleotides long. In one embodiment, the double-stranded siNA molecule does not contain any ribonucleotides. In another embodiment, the double-stranded siNA molecule comprises one or more ribonucleotides. In one embodiment, each strand of the double-stranded siNA molecule independently comprises about 15 to about 30 (e.g., about 15, 16, 17, 18, 19, 20, 21, 22, 23, 24, 25, 26, 27, 28, 29, or 30) nucleotides, wherein each strand comprises about 15 to about 30 (e.g., about 15, 16, 17, 18, 19, 20, 21, 22, 23, 24, 25, 26, 27, 28, 29, or 30) nucleotides that are complementary to the nucleotides of the other strand. In one embodiment, one of the strands of the double-stranded siNA molecule comprises a nucleotide sequence that is complementary to a nucleotide sequence or a portion thereof of the target VEGF and/or VEGFR gene, and the second strand of the double-stranded siNA molecule comprises a nucleotide sequence substantially similar to the nucleotide sequence of the target VEGF and/or VEGFR gene or a portion thereof.

In another embodiment, the invention features a double-stranded short interfering nucleic acid (siNA) molecule that down-regulates expression of a target VEGF and/or VEGFR gene or that directs cleavage of a target VEGF and/or VEGFR RNA, comprising an antisense region, wherein the antisense region comprises a nucleotide sequence that is complementary to a nucleotide sequence of the target VEGF and/or VEGFR gene or a portion thereof, and a sense region, wherein the sense region comprises a nucleotide sequence substantially similar to the nucleotide sequence of the target VEGF and/or VEGFR gene or a portion thereof. In one embodiment, the antisense region and the sense region independently comprise about 15 to about 30 (e.g. about 15, 16, 17, 18, 19, 20, 21, 22, 23, 24, 25, 26, 27, 28, 29, or 30) nucleotides, wherein the antisense region comprises about 15 to about 30 (e.g. about 15, 16, 17, 18, 19, 20, 21, 22, 23, 24, 25, 26, 27, 28, 29, or 30) nucleotides that are complementary to nucleotides of the sense region.

In another embodiment, the invention features a double-stranded short interfering nucleic acid (siNA) molecule that down-regulates expression of a target VEGF and/or VEGFR gene or that directs cleavage of a target VEGF and/or VEGFR RNA, comprising a sense region and an antisense region, wherein the antisense region comprises a nucleotide sequence that is complementary to a nucleotide sequence of RNA encoded by the target VEGF and/or VEGFR gene or a portion thereof and the sense region comprises a nucleotide sequence that is complementary to the antisense region.

In one embodiment, a siNA molecule of the invention comprises blunt ends, i.e., ends that do not include any overhanging nucleotides. For example, a siNA molecule comprising modifications described herein (e.g., comprising nucleotides having Formulae I-VII or siNA constructs comprising "Stab 00"-"Stab 34" or "Stab 3F"-"Stab 34F" (Table IV) or any combination thereof (see Table IV)) and/or any length described herein can comprise blunt ends or ends with no overhanging nucleotides.

In one embodiment, any siNA molecule of the invention can comprise one or more blunt ends, i.e. where a blunt end does not have any overhanging nucleotides. In one embodiment, the blunt ended siNA molecule has a number of base pairs equal to the number of nucleotides present in each strand of the siNA molecule. In another embodiment, the siNA molecule comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In another example, a siNA molecule comprises two blunt ends, for example wherein the 3'-end of the antisense strand and the 5'-end of the sense strand as well as the 5'-end of the antisense strand and 3'-end of the sense strand do not have any overhanging nucleotides. A blunt ended siNA molecule can comprise, for example, from about 15 to about 30 nucleotides (e.g., about 15, 16, 17, 18, 19, 20, 21, 22, 23, 24, 25, 26, 27, 28, 29, or 30 nucleotides). Other nucleotides present in a blunt ended siNA molecule can comprise, for example, mismatches, bulges, loops, or wobble base pairs to modulate the activity of the siNA molecule to mediate RNA interference.

By "blunt ends" is meant symmetric termini or termini of a double stranded siNA molecule having no overhanging nucleotides. The two strands of a double stranded siNA molecule align with each other without over-hanging nucleotides at the termini. For example, a blunt ended siNA construct comprises terminal nucleotides that are complementary between the sense and antisense regions of the siNA molecule.

In one embodiment, the invention features a double-stranded short interfering nucleic acid (siNA) molecule that down-regulates expression of a target VEGF and/or VEGFR gene or that directs cleavage of a target VEGF and/or VEGFR RNA, wherein the siNA molecule is assembled from two separate oligonucleotide fragments wherein one fragment comprises the sense region and the second fragment comprises the antisense region of the siNA molecule. The sense region can be connected to the antisense region via a linker molecule, such as a polynucleotide linker or a non-nucleotide linker.

In one embodiment, a double stranded nucleic acid molecule (e.g., siNA) molecule of the invention comprises ribonucleotides at positions that maintain or enhance RNAi activity. In one embodiment, ribonucleotides are present in the sense strand or sense region of the siNA molecule, which can provide for RNAi activity by allowing cleavage of the sense strand or sense region by an enzyme within the RISC (e.g., ribonucleotides present at the position of passenger strand, sense strand or sense region cleavage, such as position 9 of the passenger strand of a 19 base-pair duplex is cleaved in the RISC by AGO2 enzyme, see for example Matranga et al., 2005, *Cell*, 123:1-114 and Rand et al., 2005, *Cell*, 123:621-629). In another embodiment, one or more (for example 1, 2, 3, 4 or 5) nucleotides at the 5'-end of the guide strand or guide region (also known as antisense strand or antisense region) of the siNA molecule are ribonucleotides.

In one embodiment, a double stranded nucleic acid molecule (e.g., siNA) molecule of the invention comprises one or more ribonucleotides at positions within the passenger strand or passenger region (also known as the sense strand or sense region) that allows cleavage of the passenger strand or passenger region by an enzyme in the RISC complex, (e.g., ribonucleotides present at the position of passenger strand such as position 9 of the passenger strand of a 19 base-pair duplex is cleaved in the RISC by AGO2 enzyme, see for example Matranga et al., 2005, *Cell,* 123:1-114 and Rand et al., 2005, *Cell,* 123:621-629).

In one embodiment, a siNA molecule of the invention contains at least 2, 3, 4, 5, or more chemical modifications that can be the same of different. In another embodiment, a siNA molecule of the invention contains at least 2, 3, 4, 5, or more different chemical modifications.

In one embodiment, a siNA molecule of the invention is a double-stranded short interfering nucleic acid (siNA), wherein the double stranded nucleic acid molecule comprises about 15 to about 30 (e.g. about 15, 16, 17, 18, 19, 20, 21, 22, 23, 24, 25, 26, 27, 28, 29, or 30) base pairs, and wherein one or more (e.g., at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30) of the nucleotide positions in each strand of the siNA molecule comprises a chemical modification. In another embodiment, the siNA contains at least 2, 3, 4, 5, or more different chemical modifications.

In one embodiment, the invention features double-stranded short interfering nucleic acid (siNA) molecule that down-regulates expression of a target VEGF and/or VEGFR gene or that directs cleavage of a target VEGF and/or VEGFR RNA, wherein the siNA molecule comprises about 15 to about 30 (e.g. about 15, 16, 17, 18, 19, 20, 21, 22, 23, 24, 25, 26, 27, 28, 29, or 30) base pairs, and wherein each strand of the siNA molecule comprises one or more chemical modifications. In one embodiment, each strand of the double stranded siNA molecule comprises at least two (e.g., 2, 3, 4, 5, or more) different chemical modifications, e.g., different nucleotide sugar, base, or backbone modifications. In another embodiment, one of the strands of the double-stranded siNA molecule comprises a nucleotide sequence that is complementary to a nucleotide sequence of a target VEGF and/or VEGFR gene or a portion thereof, and the second strand of the double-stranded siNA molecule comprises a nucleotide sequence substantially similar to the nucleotide sequence or a portion thereof of the target VEGF and/or VEGFR gene. In another embodiment, one of the strands of the double-stranded siNA molecule comprises a nucleotide sequence that is complementary to a nucleotide sequence of a target VEGF and/or VEGFR gene or portion thereof, and the second strand of the double-stranded siNA molecule comprises a nucleotide sequence substantially similar to the nucleotide sequence or portion thereof of the target VEGF and/or VEGFR gene. In another embodiment, each strand of the siNA molecule comprises about 15 to about 30 (e.g. about 15, 16, 17, 18, 19, 20, 21, 22, 23, 24, 25, 26, 27, 28, 29, or 30) nucleotides, and each strand comprises at least about 15 to about 30 (e.g. about 15, 16, 17, 18, 19, 20, 21, 22, 23, 24, 25, 26, 27, 28, 29, or 30) nucleotides that are complementary to the nucleotides of the other strand. The target VEGF and/or VEGFR gene can comprise, for example, sequences referred to herein or incorporated herein by reference.

In one embodiment, each strand of a double stranded siNA molecule of the invention comprises a different pattern of chemical modifications, such as any "Stab 00"-"Stab 34" or "Stab 3F"-"Stab 34F" (Table IV) modification patterns herein or any combination thereof (see Table IV). Non-limiting examples of sense and antisense strands of such siNA molecules having various modification patterns are shown in Table III.

In one embodiment, a siNA molecule of the invention comprises no ribonucleotides. In another embodiment, a siNA molecule of the invention comprises ribonucleotides.

In one embodiment, a siNA molecule of the invention comprises an antisense region comprising a nucleotide sequence that is complementary to a nucleotide sequence of a target VEGF and/or VEGFR gene or a portion thereof, and the siNA further comprises a sense region comprising a nucleotide sequence substantially similar to the nucleotide sequence of the target VEGF and/or VEGFR gene or a portion thereof. In another embodiment, the antisense region and the sense region each comprise about 15 to about 30 (e.g. about 15, 16, 17, 18, 19, 20, 21, 22, 23, 24, 25, 26, 27, 28, 29, or 30) nucleotides and the antisense region comprises at least about 15 to about 30 (e.g. about 15, 16, 17, 18, 19, 20, 21, 22, 23, 24, 25, 26, 27, 28, 29, or 30) nucleotides that are complementary to nucleotides of the sense region. In one embodiment, each strand of the double stranded siNA molecule comprises at least two (e.g., 2, 3, 4, 5, or more) different chemical modifications, e.g., different nucleotide sugar, base, or backbone modifications. The target VEGF and/or VEGFR gene can comprise, for example, sequences referred to herein or incorporated by reference herein. In another embodiment, the siNA is a double stranded nucleic acid molecule, where each of the two strands of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides, and where one of the strands of the siNA molecule comprises at least about 15 (e.g. about 15, 16, 17, 18, 19, 20, 21, 22, 23, 24 or 25 or more) nucleotides that are complementary to the nucleic acid sequence of the target VEGF and/or VEGFR gene or a portion thereof.

In one embodiment, a siNA molecule of the invention comprises a sense region and an antisense region, wherein the antisense region comprises a nucleotide sequence that is complementary to a nucleotide sequence of RNA encoded by a target VEGF and/or VEGFR gene, or a portion thereof, and the sense region comprises a nucleotide sequence that is complementary to the antisense region. In one embodiment, the siNA molecule is assembled from two separate oligonucleotide fragments, wherein one fragment comprises the sense region and the second fragment comprises the antisense region of the siNA molecule. In another embodiment, the sense region is connected to the antisense region via a linker molecule. In another embodiment, the sense region is connected to the antisense region via a linker molecule, such as a nucleotide or non-nucleotide linker. In one embodiment, each strand of the double stranded siNA molecule comprises at least two (e.g., 2, 3, 4, 5, or more) different chemical modifications, e.g., different nucleotide sugar, base, or backbone modifications. The target VEGF and/or VEGFR gene can comprise, for example, sequences referred herein or incorporated by reference herein In one embodiment, the invention features a double-stranded short interfering nucleic acid (siNA) molecule that down-regulates expression of a target VEGF and/or VEGFR gene or that directs cleavage of a target VEGF and/or VEGFR RNA, comprising a sense region and an antisense region, wherein the antisense region comprises a nucleotide sequence that is complementary to a nucleotide sequence of RNA encoded by the target VEGF and/or VEGFR gene or a portion thereof and the sense region comprises a nucleotide sequence that is complementary to the antisense region, and wherein the siNA molecule has one or more modified pyrimidine and/or purine nucleotides. In one embodiment, each strand of the double stranded siNA molecule comprises at least two (e.g., 2, 3, 4, 5, or more) different chemical modifications, e.g., different nucleotide sugar, base, or backbone modifications. In one embodiment, the pyrimidine nucleotides in the sense region are 2'-O-methyl pyrimidine nucleotides or 2'-deoxy-2'-fluoro pyrimidine nucleotides and the purine nucleotides present in the sense region are 2'-deoxy purine nucleotides. In another embodiment, the pyrimidine nucleotides in the sense region are 2'-deoxy-2'-fluoro pyrimidine nucleotides and the purine nucleotides present in the sense region are 2'-O-methyl purine nucleotides. In another embodiment, the pyrimidine nucleotides in the sense region are 2'-deoxy-2'-fluoro pyrimidine nucleotides and the purine nucleotides present in the sense region are 2'-deoxy purine nucleotides. In one embodiment, the pyrimidine nucleotides in the antisense region are 2'-deoxy-2'-fluoro pyrimidine nucleotides and the purine nucleotides present in the antisense region are 2'-O-methyl or 2'-deoxy purine nucleotides. In another embodiment of any of the above-described siNA molecules, any nucleotides present in a non-complementary region of the sense strand (e.g. overhang region) are 2'-deoxy nucleotides.

In one embodiment, the invention features a double-stranded short interfering nucleic acid (siNA) molecule that down-regulates expression of a target VEGF and/or VEGFR gene or that directs cleavage of a target VEGF and/or VEGFR RNA, wherein the siNA molecule is assembled from two separate oligonucleotide fragments wherein one fragment comprises the sense region and the second fragment comprises the antisense region of the siNA molecule, and wherein the fragment comprising the sense region includes a terminal cap moiety at the 5'-end, the 3'-end, or both of the 5' and 3' ends of the fragment. In one embodiment, the terminal cap moiety is an inverted deoxy abasic moiety or glyceryl moiety. In one embodiment, each of the two fragments of the siNA molecule independently comprise about 15 to about 30 (e.g. about 15, 16, 17, 18, 19, 20, 21, 22, 23, 24, 25, 26, 27, 28, 29, or 30) nucleotides. In another embodiment, each of the two fragments of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides. In a non-limiting example, each of the two fragments of the siNA molecule comprise about 21 nucleotides.

In one embodiment, the invention features a siNA molecule comprising at least one modified nucleotide, wherein the modified nucleotide is a 2'-deoxy-2'-fluoro nucleotide, 2'-O-trifluoromethyl nucleotide, 2'-O-ethyl-trifluoromethoxy nucleotide, or 2'-O-difluoromethoxy-ethoxy nucleotide or any other modified nucleoside/nucleotide described herein and in U.S. Ser. No. 10/981,966, filed Nov. 5, 2004, incorporated by reference herein. In one embodiment, the invention features a siNA molecule comprising at least two (e.g., 2, 3, 4, 5, 6, 7, 8, 9, 10, or more) modified nucleotides, wherein the modified nucleotide is selected from the group consisting of 2'-deoxy-2'-fluoro nucleotide, 2'-O-trifluoromethyl nucleotide, 2'-O-ethyl-trifluoromethoxy nucleotide, or 2'-O-difluoromethoxy-ethoxy nucleotide or any other modified nucleoside/nucleotide described herein and in U.S. Ser. No. 10/981,966, filed Nov. 5, 2004, incorporated by reference herein. The modified nucleotide/nucleoside can be the same or different. The siNA can be, for example, about 15 to about 40 nucleotides in length. In one embodiment, all pyrimidine nucleotides present in the siNA are 2'-deoxy-2'-fluoro, 2'-O-trifluoromethyl, 2'-O-ethyl-trifluoromethoxy, or 2'-O-difluoromethoxy-ethoxy, 4'-thio pyrimidine nucleotides. In one embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-fluoro cytidine and at least one 2'-deoxy-2'-fluoro uridine nucleotides. In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a method of increasing the stability of a siNA molecule against cleavage by ribonucleases comprising introducing at least one modified nucleotide into the siNA molecule, wherein the modified nucleotide is a 2'-deoxy-2'-fluoro nucleotide. In one embodiment, all pyrimidine nucleotides present in the siNA are 2'-deoxy-2'-fluoro pyrimidine nucleotides. In one embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-fluoro cytidine and at least one 2'-deoxy-2'-fluoro uridine nucleotides. In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as a phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a double-stranded short interfering nucleic acid (siNA) molecule that down-regulates expression of a target VEGF and/or VEGFR gene or that directs cleavage of a target VEGF and/or VEGFR RNA, comprising a sense region and an antisense region, wherein the antisense region comprises a nucleotide sequence that is complementary to a nucleotide sequence of RNA encoded by the target VEGF and/or VEGFR gene or a portion thereof and the sense region comprises a nucleotide sequence that is complementary to the antisense region, and wherein the purine nucleotides present in the antisense region comprise 2'-deoxy-purine nucleotides. In an alternative embodiment, the purine nucleotides present in the antisense region comprise 2'-O-methyl purine nucleotides. In either of the above embodiments, the antisense region can comprise a phosphorothioate internucleotide linkage at the 3' end of the antisense region. Alternatively, in either of the above embodiments, the antisense region can comprise a glyceryl modification at the 3' end of the antisense region. In another embodiment of any of the above-described siNA molecules, any nucleotides present in a non-complementary region of the antisense strand (e.g. overhang region) are 2'-deoxy nucleotides.

In one embodiment, the antisense region of a siNA molecule of the invention comprises sequence complementary to a portion of an endogenous transcript having sequence unique to a particular disease or trait related allele in a subject or organism, such as sequence comprising a single nucleotide polymorphism (SNP) associated with the disease or trait specific allele. As such, the antisense region of a siNA molecule of the invention can comprise sequence complementary to sequences that are unique to a particular allele to provide specificity in mediating selective RNAi against the disease, condition, or trait related allele.

In one embodiment, the invention features a double-stranded short interfering nucleic acid (siNA) molecule that down-regulates expression of a target VEGF and/or VEGFR gene or that directs cleavage of a target VEGF and/or VEGFR RNA, wherein the siNA molecule is assembled from two separate oligonucleotide fragments wherein one fragment comprises the sense region and the second fragment comprises the antisense region of the siNA molecule. In one embodiment, each strand of the double stranded siNA molecule is about 21 nucleotides long where about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In another embodiment, the siNA molecule is a double stranded nucleic acid molecule, where each strand is about 19 nucleotide long and where the nucleotides of each fragment of the siNA molecule are base-paired to the complementary nucleotides of the other fragment of the siNA molecule to form at least about 15 (e.g., 15, 16, 17, 18, or 19) base pairs, wherein one or both ends of the siNA molecule are blunt ends. In one embodiment, each of the two 3' terminal nucleotides of each fragment of the siNA molecule is a 2'-deoxy-pyrimidine nucleotide, such as a 2'-deoxy-thymidine. In another embodiment, all nucleotides of each fragment of the siNA molecule are base-paired to the complementary nucleotides of the other fragment of the siNA molecule. In another embodiment, the siNA molecule is a double stranded nucleic acid molecule of about 19 to about 25 base pairs having a sense region and an antisense region, where about 19 nucleotides of the antisense region are base-paired to the nucleotide sequence or a portion thereof of the RNA encoded by the target VEGF and/or VEGFR gene. In another embodiment, about 21 nucleotides of the antisense region are base-paired to the nucleotide sequence or a portion thereof of the RNA encoded by the target VEGF and/or VEGFR gene. In any of the above embodiments, the 5'-end of the fragment comprising said antisense region can optionally include a phosphate group.

In one embodiment, the invention features a double-stranded short interfering nucleic acid (siNA) molecule that inhibits the expression of a target VEGF and/or VEGFR RNA sequence, wherein the siNA molecule does not contain any ribonucleotides and wherein each strand of the double-stranded siNA molecule is about 15 to about 30 nucleotides. In one embodiment, the siNA molecule is 21 nucleotides in length. Examples of non-ribonucleotide containing siNA constructs are combinations of stabilization chemistries shown in Table I in any combination of Sense/Antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, Stab 18/20, Stab 7/32, Stab 8/32, or Stab 18/32 (e.g., any siNA having Stab 7, 8, 11, 12, 13, 14, 15, 17, 18, 19, 20, or 32 sense or antisense strands or any combination thereof). Herein, numeric Stab chemistries can include both 2'-fluoro and 2'-OCF3 versions of the chemistries shown in Table I. For example, "Stab 7/8" refers to both Stab 7/8 and Stab 7F/8F etc. In one embodiment, the invention features a chemically synthesized double stranded RNA molecule that directs cleavage of a target VEGF and/or VEGFR RNA via RNA interference, wherein each strand of said RNA molecule is about 15 to about 30 nucleotides in length; one strand of the RNA molecule comprises nucleotide sequence having sufficient complementarity to the target VEGF and/or VEGFR RNA for the RNA molecule to direct cleavage of the target VEGF and/or VEGFR RNA via RNA interference; and wherein at least one strand of the RNA molecule optionally comprises one or more chemically modified nucleotides described herein, such as without limitation deoxynucleotides, 2'-O-methyl nucleotides, 2'-deoxy-2'-fluoro nucleotides, 2'-O-methoxyethyl nucleotides, 4'-thio nucleotides, 2'-O-trifluoromethyl nucleotides, 2'-O-ethyl-trifluoromethoxy nucleotides, 2'-O-difluoromethoxy-ethoxy nucleotides, etc.

In one embodiment, a target VEGF and/or VEGFR RNA of the invention comprises sequence encoding a protein.

In one embodiment, target VEGF and/or VEGFR RNA of the invention comprises non-coding RNA sequence (e.g., miRNA, snRNA, siRNA etc.), see for example Mattick, 2005, *Science*, 309, 1527-1528 and Claverie, 2005, *Science*, 309, 1529-1530.

In one embodiment, the invention features a medicament comprising a siNA molecule of the invention.

In one embodiment, the invention features an active ingredient comprising a siNA molecule of the invention.

In one embodiment, the invention features the use of a double-stranded short interfering nucleic acid (siNA) molecule to inhibit, down-regulate, or reduce expression of a target VEGF and/or VEGFR gene, wherein the siNA molecule comprises one or more chemical modifications and each strand of the double-stranded siNA is independently about 15 to about 30 or more (e.g., about 15, 16, 17, 18, 19, 20, 21, 22, 23, 24, 25, 26, 27, 28, 29 or 30 or more) nucleotides long. In one embodiment, the siNA molecule of the invention is a double stranded nucleic acid molecule comprising one or more chemical modifications, where each of the two fragments of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides and where one of the strands comprises at least 15 nucleotides that are complementary to nucleotide sequence of target VEGF and/or VEGFR encoding RNA or a portion thereof. In a non-limiting example, each of the two fragments of the siNA molecule comprise about 21 nucleotides. In another embodiment, the siNA molecule is a double stranded nucleic acid molecule comprising one or more chemical modifications, where each strand is about 21 nucleotide long and where about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In another embodiment, the siNA molecule is a double stranded nucleic acid molecule comprising one or more chemical modifications, where each strand is about 19 nucleotide long and where the nucleotides of each fragment of the siNA molecule are base-paired to the complementary nucleotides of the other fragment of the siNA molecule to form at least about 15 (e.g., 15,16, 17, 18, or 19) base pairs, wherein one or both ends of the siNA molecule are blunt ends. In one embodiment, each of the two 3' terminal nucleotides of each fragment of the siNA molecule is a 2'-deoxy-pyrimidine nucleotide, such as a 2'-deoxy-thymidine. In another embodiment, all nucleotides of each fragment of the siNA molecule are base-paired to the complementary nucleotides of the other fragment of the siNA molecule. In another embodiment, the siNA molecule is a double stranded nucleic acid molecule of about 19 to about 25 base pairs having a sense region and an antisense region and comprising one or more chemical modifications, where about 19 nucleotides of the antisense region are base-paired to the nucleotide sequence or a portion thereof of the RNA encoded by the target VEGF and/or VEGFR gene. In another embodiment, about 21 nucleotides of the antisense region are base-paired to the nucleotide sequence or a portion thereof of the RNA encoded by the target VEGF and/or VEGFR gene. In any of the above embodiments, the 5'-end of the fragment comprising said antisense region can optionally include a phosphate group.

In one embodiment, the invention features the use of a double-stranded short interfering nucleic acid (siNA) molecule that inhibits, down-regulates, or reduces expression of a target VEGF and/or VEGFR gene, wherein one of the strands of the double-stranded siNA molecule is an antisense strand which comprises nucleotide sequence that is complementary to nucleotide sequence of target VEGF and/or VEGFR RNA or a portion thereof, the other strand is a sense strand which comprises nucleotide sequence that is complementary to a nucleotide sequence of the antisense strand. In one embodiment, each strand has at least two (e.g., 2, 3, 4, 5, or more) chemical modifications, which can be the same or different, such as nucleotide, sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification.

In one embodiment, the invention features a double-stranded short interfering nucleic acid (siNA) molecule that inhibits, down-regulates, or reduces expression of a target VEGF and/or VEGFR gene, wherein one of the strands of the double-stranded siNA molecule is an antisense strand which comprises nucleotide sequence that is complementary to nucleotide sequence of target VEGF and/or VEGFR RNA or a portion thereof, wherein the other strand is a sense strand which comprises nucleotide sequence that is complementary to a nucleotide sequence of the antisense strand. In one embodiment, each strand has at least two (e.g., 2, 3, 4, 5, or more) chemical modifications, which can be the same or different, such as nucleotide, sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification.

In one embodiment, the invention features a double-stranded short interfering nucleic acid (siNA) molecule that inhibits, down-regulates, or reduces expression of a target VEGF and/or VEGFR gene, wherein one of the strands of the double-stranded siNA molecule is an antisense strand which comprises nucleotide sequence that is complementary to nucleotide sequence of target VEGF and/or VEGFR RNA that encodes a protein or portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification. In one embodiment, each strand of the siNA molecule comprises about 15 to about 30 or more (e.g., about 15, 16, 17, 18, 19, 20, 21, 22, 23, 24, 25, 26, 27, 28, 29, or 30 or more) nucleotides, wherein each strand comprises at least about 15 nucleotides that are complementary to the nucleotides of the other strand. In one embodiment, the siNA molecule is assembled from two oligonucleotide fragments, wherein one fragment comprises the nucleotide sequence of the antisense strand of the siNA molecule and a second fragment comprises nucleotide sequence of the sense region of the siNA molecule. In one embodiment, the sense strand is connected to the antisense strand via a linker molecule, such as a polynucleotide linker or a non-nucleotide linker. In a further embodiment, the pyrimidine nucleotides present in the sense strand are 2'-deoxy-2'fluoro pyrimidine nucleotides and the purine nucleotides present in the sense region are 2'-deoxy purine nucleotides. In another embodiment, the pyrimidine nucleotides present in the sense strand are 2'-deoxy-2'-fluoro pyrimidine nucleotides and the purine nucleotides present in the sense region are 2'-O-methyl purine nucleotides. In still another embodiment, the pyrimidine nucleotides present in the antisense strand are 2'-deoxy-2'-fluoro pyrimidine nucleotides and any purine nucleotides present in the antisense strand are 2'-deoxy purine nucleotides. In another embodiment, the antisense strand comprises one or more 2'-deoxy-2'-fluoro pyrimidine nucleotides and one or more 2'-O-methyl purine nucleotides. In another embodiment, the pyrimidine nucleotides present in the antisense strand are 2'-deoxy-2'-fluoro pyrimidine nucleotides and any purine nucleotides present in the antisense strand are 2'-O-methyl purine nucleotides. In a further embodiment the sense strand comprises a 3'-end and a 5'-end, wherein a terminal cap moiety (e.g., an inverted deoxy abasic moiety or inverted deoxy nucleotide moiety such as inverted thymidine) is present at the 5'-end, the 3'-end, or both of the 5' and 3' ends of the sense strand. In another embodiment, the antisense strand comprises a phosphorothioate internucleotide linkage at the 3' end of the antisense strand. In another embodiment, the antisense strand comprises a glyceryl modification at the 3' end. In another embodiment, the 5'-end of the antisense strand optionally includes a phosphate group.

In any of the above-described embodiments of a double-stranded short interfering nucleic acid (siNA) molecule that inhibits expression of a target VEGF and/or VEGFR gene, wherein a majority of the pyrimidine nucleotides present in the double-stranded siNA molecule comprises a sugar modification, each of the two strands of the siNA molecule can comprise about 15 to about 30 or more (e.g., about 15, 16, 17, 18, 19, 20, 21, 22, 23, 24, 25, 26, 27, 28, 29, or 30 or more) nucleotides. In one embodiment, about 15 to about 30 or more (e.g., about 15, 16, 17, 18, 19, 20, 21, 22, 23, 24, 25, 26, 27, 28, 29, or 30 or more) nucleotides of each strand of the siNA molecule are base-paired to the complementary nucleotides of the other strand of the siNA molecule. In another embodiment, about 15 to about 30 or more (e.g., about 15, 16, 17, 18, 19, 20, 21, 22, 23, 24, 25, 26, 27, 28, 29, or 30 or more) nucleotides of each strand of the siNA molecule are base-paired to the complementary nucleotides of the other strand of the siNA molecule, wherein at least two 3' terminal nucleotides of each strand of the siNA molecule are not base-paired to the nucleotides of the other strand of the siNA molecule. In another embodiment, each of the two 3' terminal nucleotides of each fragment of the siNA molecule is a 2'-deoxy-pyrimidine, such as 2'-deoxy-thymidine. In one embodiment, each strand of the siNA molecule is base-paired to the complementary nucleotides of the other strand of the siNA molecule. In one embodiment, about 15 to about 30 (e.g., about 15, 16, 17, 18, 19, 20, 21, 22, 23, 24, 25, 26, 27, 28, 29, or 30) nucleotides of the antisense strand are base-paired to the nucleotide sequence of the target VEGF and/or VEGFR RNA or a portion thereof. In one embodiment, about 18 to about 25 (e.g., about 18, 19, 20, 21, 22, 23, 24, or 25) nucleotides of the antisense strand are base-paired to the nucleotide sequence of the target VEGF and/or VEGFR RNA or a portion thereof.

In one embodiment, the invention features a double-stranded short interfering nucleic acid (siNA) molecule that inhibits expression of a target VEGF and/or VEGFR gene, wherein one of the strands of the double-stranded siNA molecule is an antisense strand which comprises nucleotide sequence that is complementary to nucleotide sequence of target VEGF and/or VEGFR RNA or a portion thereof, the other strand is a sense strand which comprises nucleotide sequence that is complementary to a nucleotide sequence of the antisense strand. In one embodiment, each strand has at least two (e.g., 2, 3, 4, 5, or more) different chemical modifications, such as nucleotide sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification. In one embodiment, the 5'-end of the antisense strand optionally includes a phosphate group.

In one embodiment, the invention features a double-stranded short interfering nucleic acid (siNA) molecule that inhibits expression of a target VEGF and/or VEGFR gene, wherein one of the strands of the double-stranded siNA molecule is an antisense strand which comprises nucleotide sequence that is complementary to nucleotide sequence of target VEGF and/or VEGFR RNA or a portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification, and wherein the nucleotide sequence or a portion thereof of the antisense strand is complementary to a nucleotide sequence of the untranslated region or a portion thereof of the target VEGF and/or VEGFR RNA.

In one embodiment, the invention features a double-stranded short interfering nucleic acid (siNA) molecule that inhibits expression of a target VEGF and/or VEGFR gene, wherein one of the strands of the double-stranded siNA molecule is an antisense strand which comprises nucleotide sequence that is complementary to nucleotide sequence of target VEGF and/or VEGFR RNA or a portion thereof, wherein the other strand is a sense strand which comprises nucleotide sequence that is complementary to a nucleotide sequence of the antisense strand, wherein a majority of the pyrimidine nucleotides present in the double-stranded siNA molecule comprises a sugar modification, and wherein the nucleotide sequence of the antisense strand is complementary to a nucleotide sequence of the target VEGF and/or VEGFR RNA or a portion thereof that is present in the target VEGF and/or VEGFR RNA.

In one embodiment, the invention features a composition comprising a siNA molecule of the invention in a pharmaceutically acceptable carrier or diluent.

In a non-limiting example, the introduction of chemically-modified nucleotides into nucleic acid molecules provides a powerful tool in overcoming potential limitations of in vivo stability and bioavailability inherent to native RNA molecules that are delivered exogenously. For example, the use of chemically-modified nucleic acid molecules can enable a lower dose of a particular nucleic acid molecule for a given therapeutic effect since chemically-modified nucleic acid molecules tend to have a longer half-life in serum. Furthermore, certain chemical modifications can improve the bioavailability of nucleic acid molecules by target VEGF and/or VEGFRing particular cells or tissues and/or improving cellular uptake of the nucleic acid molecule. Therefore, even if the activity of a chemically-modified nucleic acid molecule is reduced as compared to a native nucleic acid molecule, for example, when compared to an all-RNA nucleic acid molecule, the overall activity of the modified nucleic acid molecule can be greater than that of the native molecule due to improved stability and/or delivery of the molecule. Unlike native unmodified siNA, chemically-modified siNA can also minimize the possibility of activating interferon activity or immunostimulation in humans.

In any of the embodiments of siNA molecules described herein, the antisense region of a siNA molecule of the invention can comprise a phosphorothioate internucleotide linkage at the 3'-end of said antisense region. In any of the embodiments of siNA molecules described herein, the antisense region can comprise about one to about five phosphorothioate internucleotide linkages at the 5'-end of said antisense region. In any of the embodiments of siNA molecules described herein, the 3'-terminal nucleotide overhangs of a siNA molecule of the invention can comprise ribonucleotides or deoxyribonucleotides that are chemically-modified at a nucleic acid sugar, base, or backbone. In any of the embodiments of siNA molecules described herein, the 3'-terminal nucleotide overhangs can comprise one or more universal base ribonucleotides. In any of the embodiments of siNA molecules described herein, the 3'-terminal nucleotide overhangs can comprise one or more acyclic nucleotides.

One embodiment of the invention provides an expression vector comprising a nucleic acid sequence encoding at least one siNA molecule of the invention in a manner that allows expression of the nucleic acid molecule. Another embodiment of the invention provides a mammalian cell comprising such an expression vector. The mammalian cell can be a human cell. The siNA molecule of the expression vector can comprise a sense region and an antisense region. The antisense region can comprise sequence complementary to a RNA or DNA sequence encoding a target VEGF and/or VEGFR and the sense region can comprise sequence complementary to the antisense region. The siNA molecule can comprise two distinct strands having complementary sense and antisense regions. The siNA molecule can comprise a single strand having complementary sense and antisense regions.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides comprising a backbone modified internucleotide linkage having Formula I:

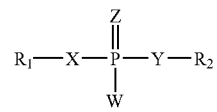

wherein each R1 and R2 is independently any nucleotide, non-nucleotide, or polynucleotide which can be naturally-occurring or chemically-modified and which can be included in the structure of the siNA molecule or serve as a point of attachment to the siNA molecule, each X and Y is independently O, S, N, alkyl, or substituted alkyl, each Z and W is independently O, S, N, alkyl, substituted alkyl, O-alkyl, S-alkyl, alkaryl, aralkyl, or acetyl and wherein W, X, Y, and Z are optionally not all O. In another embodiment, a backbone modification of the invention comprises a phosphonoacetate and/or thiophosphonoacetate internucleotide linkage (see for example Sheehan et al., 2003, Nucleic Acids Research, 31, 4109-4118).

The chemically-modified internucleotide linkages having Formula I, for example, wherein any Z, W, X, and/or Y independently comprises a sulphur atom, can be present in one or both oligonucleotide strands of the siNA duplex, for example, in the sense strand, the antisense strand, or both strands. The siNA molecules of the invention can comprise one or more (e.g., about 1, 2, 3, 4, 5, 6, 7, 8, 9, 10, or more) chemically-modified internucleotide linkages having Formula I at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified internucleotide linkages having Formula I at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine nucleotides with chemically-modified internucleotide linkages having Formula I in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine nucleotides with chemically-modified internucleotide linkages having Formula I in the sense strand, the antisense strand, or both strands. In another embodiment, a siNA molecule of the invention having internucleotide linkage(s) of Formula I also comprises a chemically-modified nucleotide or non-nucleotide having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula II:

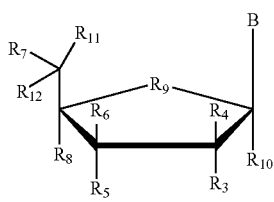

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

The chemically-modified nucleotide or non-nucleotide of Formula II can be present in one or both oligonucleotide strands of the siNA duplex, for example in the sense strand, the antisense strand, or both strands. The siNA molecules of the invention can comprise one or more chemically-modified nucleotides or non-nucleotides of Formula II at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotides or non-nucleotides of Formula II at the 5'-end of the sense strand, the antisense strand, or both strands. In anther non-limiting example, an exemplary siNA molecule of the invention can comprise about 1 to about 5 or more (e.g., about 1, 2, 3, 4, 5, or more) chemically-modified nucleotides or non-nucleotides of Formula II at the 3'-end of the sense strand, the antisense strand, or both strands.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula III:

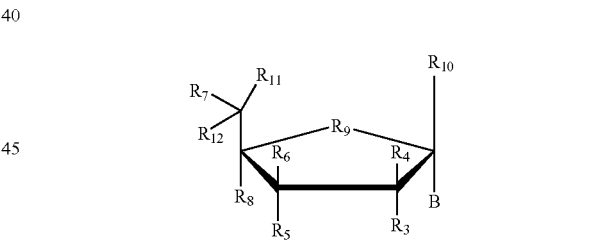

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

The chemically-modified nucleotide or non-nucleotide of Formula III can be present in one or both oligonucleotide strands of the siNA duplex, for example, in the sense strand, the antisense strand, or both strands. The siNA molecules of the invention can comprise one or more chemically-modified nucleotides or non-nucleotides of Formula III at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotide(s) or non-nucleotide(s) of Formula III at the 5'-end of the sense strand, the antisense strand, or both strands. In anther non-limiting example, an exemplary siNA molecule of the invention can comprise about 1 to about 5 or more (e.g., about 1, 2, 3, 4, 5, or more) chemically-modified nucleotide or non-nucleotide of Formula III at the 3'-end of the sense strand, the antisense strand, or both strands.

In another embodiment, a siNA molecule of the invention comprises a nucleotide having Formula II or III, wherein the nucleotide having Formula II or III is in an inverted configuration. For example, the nucleotide having Formula II or III is connected to the siNA construct in a 3'-3', 3'-2', 2'-3', or 5'-5' configuration, such as at the 3'-end, the 5'-end, or both of the 3' and 5'-ends of one or both siNA strands.

In one embodiment, the invention features a chemically-modified short interfering nucleic acid (siNA) molecule capable of mediating RNA interference (RNAi) inside a cell or reconstituted in vitro system, wherein the chemical modification comprises a 5'-terminal phosphate group having Formula IV:

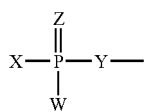

wherein each X and Y is independently O, S, N, alkyl, substituted alkyl, or alkylhalo; wherein each Z and W is independently O, S, N, alkyl, substituted alkyl, O-alkyl, S-alkyl, alkaryl, aralkyl, alkylhalo, or acetyl; and wherein W, X, Y and Z are optionally not all O and Y serves as a point of attachment to the siNA molecule.

In one embodiment, the invention features a siNA molecule having a 5'-terminal phosphate group having Formula IV on the target VEGF and/or VEGFR-complementary strand, for example, a strand complementary to a target VEGF and/or VEGFR RNA, wherein the siNA molecule comprises an all RNA siNA molecule. In another embodiment, the invention features a siNA molecule having a 5'-terminal phosphate group having Formula IV on the target VEGF and/or VEGFR-complementary strand wherein the siNA molecule also comprises about 1 to about 3 (e.g., about 1, 2, or 3) nucleotide 3'-terminal nucleotide overhangs having about 1 to about 4 (e.g., about 1, 2, 3, or 4) deoxyribonucleotides on the 3'-end of one or both strands. In another embodiment, a 5'-terminal phosphate group having Formula IV is present on the target VEGF and/or VEGFR-complementary strand of a siNA molecule of the invention, for example a siNA molecule having chemical modifications having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more phosphorothioate internucleotide linkages. For example, in a non-limiting example, the invention features a chemically-modified short interfering nucleic acid (siNA) having about 1, 2, 3, 4, 5, 6, 7, 8 or more phosphorothioate internucleotide linkages in one siNA strand. In yet another embodiment, the invention features a chemically-modified short interfering nucleic acid (siNA) individually having about 1, 2, 3, 4, 5, 6, 7, 8 or more phosphorothioate internucleotide linkages in both siNA strands. The phosphorothioate internucleotide linkages can be present in one or both oligonucleotide strands of the siNA duplex, for example in the sense strand, the antisense strand, or both strands. The siNA molecules of the invention can comprise one or more phosphorothioate internucleotide linkages at the 3'-end, the 5'-end, or both of the 3'- and 5'-ends of the sense strand, the antisense strand, or both strands. For example, an exemplary siNA molecule of the invention can comprise about 1 to about 5 or more (e.g., about 1, 2, 3, 4, 5, or more) consecutive phosphorothioate internucleotide linkages at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine phosphorothioate internucleotide linkages in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine phosphorothioate internucleotide linkages in the sense strand, the antisense strand, or both strands.

Each strand of the double stranded siNA molecule can have one or more chemical modifications such that each strand comprises a different pattern of chemical modifications. Several non-limiting examples of modification schemes that could give rise to different patterns of modifications are provided herein.

In one embodiment, the invention features a siNA molecule, wherein the sense strand comprises one or more, for example, about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy and/or about one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without one or more, for example about 1, 2, 3, 4, 5, 6, 7, 8, 9, 10, or more, phosphorothioate internucleotide linkages and/or a terminal cap molecule at the 3'-end, the 5'-end, or both of the 3'- and 5-ends, being present in the same or different strand.

In another embodiment, the invention features a siNA molecule, wherein the sense strand comprises about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand comprises about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

In one embodiment, the invention features a siNA molecule, wherein the antisense strand comprises one or more, for example, about 1, 2, 3, 4, 5, 6, 7, 8, 9, 10, or more phosphorothioate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without one or more, for example, about 1, 2, 3, 4, 5, 6, 7, 8, 9, 10 or more phosphorothioate internucleotide linkages and/or a terminal cap molecule at the 3'-end, the 5'-end, or both of the 3' and 5'-ends, being present in the same or different strand.

In another embodiment, the invention features a siNA molecule, wherein the antisense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without about 1 to about 5, for example about 1, 2, 3, 4, 5 or more phosphorothioate internucleotide linkages and/or a terminal cap molecule at the 3'-end, the 5'-end, or both of the 3'- and 5'-ends, being present in the same or different strand.

In one embodiment, the invention features a chemically-modified short interfering nucleic acid (siNA) molecule having about 1 to about 5 or more (specifically about 1, 2, 3, 4, 5 or more) phosphorothioate internucleotide linkages in each strand of the siNA molecule.

In another embodiment, the invention features a siNA molecule comprising 2'-5' internucleotide linkages. The 2'-5' internucleotide linkage(s) can be at the 3'-end, the 5'-end, or both of the 3'- and 5'-ends of one or both siNA sequence strands. In addition, the 2'-5' internucleotide linkage(s) can be present at various other positions within one or both siNA sequence strands, for example, about 1, 2, 3, 4, 5, 6, 7, 8, 9, 10, or more including every internucleotide linkage of a pyrimidine nucleotide in one or both strands of the siNA molecule can comprise a 2'-5' internucleotide linkage, or about 1, 2, 3, 4, 5, 6, 7, 8, 9, 10, or more including every internucleotide linkage of a purine nucleotide in one or both strands of the siNA molecule can comprise a 2'-5' internucleotide linkage.

In another embodiment, a chemically-modified siNA molecule of the invention comprises a duplex having two strands, one or both of which can be chemically-modified, wherein each strand is independently about 15 to about 30 (e.g., about 15, 16, 17, 18, 19, 20, 21, 22, 23, 24, 25, 26, 27, 28, 29, or 30) nucleotides in length, wherein the duplex has about 15 to about 30 (e.g., about 15, 16, 17, 18, 19, 20, 21, 22, 23, 24, 25, 26, 27, 28, 29, or 30) base pairs, and wherein the chemical modification comprises a structure having any of Formulae I-VII. For example, an exemplary chemically-modified siNA molecule of the invention comprises a duplex having two strands, one or both of which can be chemically-modified with a chemical modification having any of Formulae I-VII or any combination thereof, wherein each strand consists of about 21 nucleotides, each having a 2-nucleotide 3'-terminal nucleotide overhang, and wherein the duplex has about 19 base pairs. In another embodiment, a siNA molecule of the invention comprises a single stranded hairpin structure, wherein the siNA is about 36 to about 70 (e.g., about 36, 40, 45, 50, 55, 60, 65, or 70) nucleotides in length having about 15 to about 30 (e.g., about 15, 16, 17, 18, 19, 20, 21, 22, 23, 24, 25, 26, 27, 28, 29, or 30) base pairs, and wherein the siNA can include a chemical modification comprising a structure having any of Formulae I-VII or any combination thereof. For example, an exemplary chemically-modified siNA molecule of the invention comprises a linear oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the linear oligonucleotide forms a hairpin structure having about 19 to about 21 (e.g., 19, 20, or 21) base pairs and a 2-nucleotide 3'-terminal nucleotide overhang. In another embodiment, a linear hairpin siNA molecule of the invention contains a stem loop motif, wherein the loop portion of the siNA molecule is biodegradable. For example, a linear hairpin siNA molecule of the invention is designed such that degradation of the loop portion of the siNA molecule in vivo can generate a double-stranded siNA molecule with 3'-terminal overhangs, such as 3'-terminal nucleotide overhangs comprising about 2 nucleotides.

In another embodiment, a siNA molecule of the invention comprises a hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms a hairpin structure having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs and a 5'-terminal phosphate group that can be chemically modified as described herein (for example a 5'-terminal phosphate group having Formula IV). In another embodiment, a linear hairpin siNA molecule of the invention contains a stem loop motif, wherein the loop portion of the siNA molecule is biodegradable. In one embodiment, a linear hairpin siNA molecule of the invention comprises a loop portion comprising a non-nucleotide linker.

In another embodiment, a siNA molecule of the invention comprises an asymmetric hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms an asymmetric hairpin structure having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs and a 5'-terminal phosphate group that can be chemically modified as described herein (for example a 5'-terminal phosphate group having Formula IV). In one embodiment, an asymmetric hairpin siNA molecule of the invention contains a stem loop motif, wherein the loop portion of the siNA molecule is biodegradable. In another embodiment, an asymmetric hairpin siNA molecule of the invention comprises a loop portion comprising a non-nucleotide linker.

In another embodiment, a siNA molecule of the invention comprises an asymmetric double stranded structure having separate polynucleotide strands comprising sense and antisense regions, wherein the antisense region is about 15 to about 30 (e.g., about 15, 16, 17, 18, 19, 20, 21, 22, 23, 24, 25, 26, 27, 28, 29, or 30) nucleotides in length, wherein the sense region is about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides in length, wherein the sense region and the antisense region have at least 3 complementary nucleotides, and wherein the siNA can include one or more chemical modifications comprising a structure having any of Formulae I-VII or any combination thereof. For example, an exemplary chemically-modified siNA molecule of the invention comprises an asymmetric double stranded structure having separate polynucleotide strands comprising sense and antisense regions, wherein the antisense region is about 18 to about 23 (e.g., about 18, 19, 20, 21, 22, or 23) nucleotides in length and wherein the sense region is about 3 to about 15 (e.g., about 3, 4, 5, 6, 7, 8, 9, 10, 11, 12, 13, 14, or 15) nucleotides in length, wherein the sense region the antisense region have at least 3 complementary nucleotides, and wherein the siNA can include one or more chemical modifications comprising a structure having any of Formulae I-VII or any combination thereof. In another embodiment, the asymmetric double stranded siNA molecule can also have a 5'-terminal phosphate group that can be chemically modified as described herein (for example a 5'-terminal phosphate group having Formula IV).

In another embodiment, a siNA molecule of the invention comprises a circular nucleic acid molecule, wherein the siNA is about 38 to about 70 (e.g., about 38, 40, 45, 50, 55, 60, 65, or 70) nucleotides in length having about 15 to about 30 (e.g., about 15, 16, 17, 18, 19, 20, 21, 22, 23, 24, 25, 26, 27, 28, 29, or 30) base pairs, and wherein the siNA can include a chemical modification, which comprises a structure having any of Formulae I-VII or any combination thereof. For example, an exemplary chemically-modified siNA molecule of the invention comprises a circular oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the circular oligonucleotide forms a dumbbell shaped structure having about 19 base pairs and 2 loops.

In another embodiment, a circular siNA molecule of the invention contains two loop motifs, wherein one or both loop portions of the siNA molecule is biodegradable. For example, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In one embodiment, a siNA molecule of the invention comprises at least one (e.g., about 1, 2, 3, 4, 5, 6, 7, 8, 9, 10, or more) abasic moiety, for example a compound having Formula V:

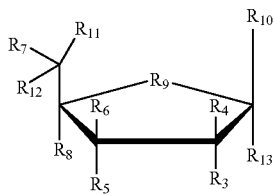

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

In one embodiment, a siNA molecule of the invention comprises at least one (e.g., about 1, 2, 3, 4, 5, 6, 7, 8, 9, 10, or more) inverted abasic moiety, for example a compound having Formula VI:

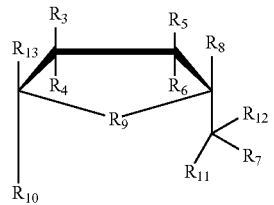

wherein each R3, R4, R5, R6, R7, R8, R10, R1, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and either R2, R3, R8 or R13 serve as points of attachment to the siNA molecule of the invention. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

In another embodiment, a siNA molecule of the invention comprises at least one (e.g., about 1, 2, 3, 4, 5, 6, 7, 8, 9, 10, or more) substituted polyalkyl moieties, for example a compound having Formula VII:

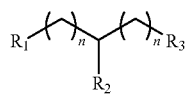

wherein each n is independently an integer from 1 to 12, each R1, R2 and R3 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule. In one embodiment, R3 and/or R1 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

By "ZIP code" sequences is meant, any peptide or protein sequence that is involved in cellular topogenic signaling mediated transport (see for example Ray et al., 2004, *Science*, 306(1501): 1505)

Each nucleotide within the double stranded siNA molecule can independently have a chemical modification comprising the structure of any of Formulae I-VIII. Thus, in one embodiment, one or more nucleotide positions of a siNA molecule of the invention comprises a chemical modification having structure of any of Formulae I-VII or any other modification herein. In one embodiment, each nucleotide position of a siNA molecule of the invention comprises a chemical modification having structure of any of Formulae I-VII or any other modification herein.

In one embodiment, one or more nucleotide positions of one or both strands of a double stranded siNA molecule of the invention comprises a chemical modification having structure of any of Formulae 1-VII or any other modification herein. In one embodiment, each nucleotide position of one or both strands of a double stranded siNA molecule of the invention comprises a chemical modification having structure of any of Formulae I-VII or any other modification herein.

In another embodiment, the invention features a compound having Formula VII, wherein R1 and R2 are hydroxyl (OH) groups, n=1, and R3 comprises O and is the point of attachment to the 3'-end, the 5'-end, or both of the 3' and 5'-ends of one or both strands of a double-stranded siNA molecule of the invention or to a single-stranded siNA molecule of the invention. This modification is referred to herein as "glyceryl" (for example modification 6 in FIG. 10).

In another embodiment, a chemically modified nucleoside or non-nucleoside (e.g. a moiety having any of Formula V, VI or VII) of the invention is at the 3'-end, the 5'-end, or both of the 3' and 5'-ends of a siNA molecule of the invention. For example, chemically modified nucleoside or non-nucleoside (e.g., a moiety having Formula V, VI or VII) can be present at the 3'-end, the 5'-end, or both of the 3' and 5'-ends of the antisense strand, the sense strand, or both antisense and sense strands of the siNA molecule. In one embodiment, the chemically modified nucleoside or non-nucleoside (e.g., a moiety having Formula V, VI or VII) is present at the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the terminal position of the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the two terminal positions of the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the penultimate position of the 5'-end and 3'-end of the sense strand and the 3'-end of the antisense strand of a double stranded siNA molecule of the invention. In addition, a moiety having Formula VII can be present at the 3'-end or the 5'-end of a hairpin siNA molecule as described herein.

In another embodiment, a siNA molecule of the invention comprises an abasic residue having Formula V or VI, wherein the abasic residue having Formula VI or VI is connected to the siNA construct in a 3'-3', 3'-2', 2'-3', or 5'-5' configuration, such as at the 3'-end, the 5'-end, or both of the 3' and 5'-ends of one or both siNA strands.

In one embodiment, a siNA molecule of the invention comprises one or more (e.g., about 1, 2, 3, 4, 5, 6, 7, 8, 9, 10, or more) locked nucleic acid (LNA) nucleotides, for example, at the 5'-end, the 3'-end, both of the 5' and 3'-ends, or any combination thereof, of the siNA molecule.

In one embodiment, a siNA molecule of the invention comprises one or more (e.g., about 1, 2, 3, 4, 5, 6, 7, 8, 9, 10, or more) 4'-thio nucleotides, for example, at the 5'-end, the 3'-end, both of the 5' and 3'-ends, or any combination thereof, of the siNA molecule.

In another embodiment, a siNA molecule of the invention comprises one or more (e.g., about 1, 2, 3, 4, 5, 6, 7, 8, 9, 10, or more) acyclic nucleotides, for example, at the 5'-end, the 3'-end, both of the 5' and 3'-ends, or any combination thereof, of the siNA molecule.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the sense region are 2'-O-methyl purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), wherein any (e.g., one or more or all) purine nucleotides present in the sense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and wherein any nucleotides comprising a 3'-terminal nucleotide overhang that are present in said antisense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention capable of mediating RNA interference (RNAi) inside a cell or reconstituted in vitro system comprising a sense region, wherein one or more pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethoxy, 2'-O-ethyl-trifluoromethoxy, or 2'-O-difluoromethoxy-ethoxy pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and one or more purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). The sense region and/or the antisense region can have a terminal cap modification, such as any modification described herein or shown in FIG. 10, that is optionally present at the 3'-end, the 5'-end, or both of the 3' and 5'-ends of the sense and/or antisense sequence. The sense and/or antisense region can optionally further comprise a 3'-terminal nucleotide overhang having about 1 to about 4 (e.g., about 1, 2, 3, or 4) 2'-deoxynucleotides. The overhang nucleotides can further comprise one or more (e.g., about 1, 2, 3, 4 or more) phosphorothioate, phosphonoacetate, and/or thiophosphonoacetate internucleotide linkages. Non-limiting examples of these chemically-modified siNAs are shown in FIGS. 4 and 5 and Table I herein. In any of these described embodiments, the purine nucleotides present in the sense region are alternatively 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides) and one or more purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). Also, in any of these embodiments, one or more purine nucleotides present in the sense region are alternatively purine ribonucleotides (e.g., wherein all purine nucleotides are purine ribonucleotides or alternately a plurality of purine nucleotides are purine ribonucleotides) and any purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). Additionally, in any of these embodiments, one or more purine nucleotides present in the sense region and/or present in the antisense region are alternatively selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides).

In another embodiment, any modified nucleotides present in the siNA molecules of the invention, preferably in the antisense strand of the siNA molecules of the invention, but also optionally in the sense and/or both antisense and sense strands, comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984) otherwise known as a "ribo-like" or "A-form helix" configuration. As such, chemically modified nucleotides present in the siNA molecules of the invention, preferably in the antisense strand of the siNA molecules of the invention, but also optionally in the sense and/or both antisense and sense strands, are resistant to nuclease degradation while at the same time maintaining the capacity to mediate RNAi. Non-limiting examples of nucleotides having a northern configuration include locked nucleic acid (LNA) nucleotides (e.g., 2'-O, 4'-C-methylene-(D-ribofuranosyl) nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, 2'-O-trifluoromethyl nucleotides, 2'-O-ethyl-trifluoromethoxy nucleotides, 2'-O-difluoromethoxy-ethoxy nucleotides, 4'-thio nucleotides and 2'-O-methyl nucleotides.

In one embodiment, the sense strand of a double stranded siNA molecule of the invention comprises a terminal cap moiety, (see for example FIG. 10) such as an inverted deoxyabaisc moiety, at the 3'-end, 5'-end, or both 3' and 5'-ends of the sense strand.

In one embodiment, the invention features a chemically-modified short interfering nucleic acid molecule (siNA) capable of mediating RNA interference (RNAi) inside a cell or reconstituted in vitro system, wherein the chemical modification comprises a conjugate covalently attached to the chemically-modified siNA molecule. Non-limiting examples of conjugates contemplated by the invention include conjugates and ligands described in Vargeese et al., U.S. Ser. No. 10/427,160, filed Apr. 30, 2003, incorporated by reference herein in its entirety, including the drawings. In another embodiment, the conjugate is covalently attached to the chemically-modified siNA molecule via a biodegradable linker. In one embodiment, the conjugate molecule is attached at the 3'-end of either the sense strand, the antisense strand, or both strands of the chemically-modified siNA molecule. In another embodiment, the conjugate molecule is attached at the 5'-end of either the sense strand, the antisense strand, or both strands of the chemically-modified siNA molecule. In yet another embodiment, the conjugate molecule is attached both the 3'-end and 5'-end of either the sense strand, the antisense strand, or both strands of the chemically-modified siNA molecule, or any combination thereof. In one embodiment, a conjugate molecule of the invention comprises a molecule that facilitates delivery of a chemically-modified siNA molecule into a biological system, such as a cell. In another embodiment, the conjugate molecule attached to the chemically-modified siNA molecule is a ligand for a cellular receptor, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine. Examples of specific conjugate molecules contemplated by the instant invention that can be attached to chemically-modified siNA molecules are described in Vargeese et al., U.S. Ser. No. 10/201,394, filed Jul. 22, 2002 incorporated by reference herein. The type of conjugates used and the extent of conjugation of siNA molecules of the invention can be evaluated for improved pharmacokinetic profiles, bioavailability, and/or stability of siNA constructs while at the same time maintaining the ability of the siNA to mediate RNAi activity. As such, one skilled in the art can screen siNA constructs that are modified with various conjugates to determine whether the siNA conjugate complex possesses improved properties while maintaining the ability to mediate RNAi, for example in animal models as are generally known in the art.

In one embodiment, the invention features a short interfering nucleic acid (siNA) molecule of the invention, wherein the siNA further comprises a nucleotide, non-nucleotide, or mixed nucleotide/non-nucleotide linker that joins the sense region of the siNA to the antisense region of the siNA. In one embodiment, a nucleotide, non-nucleotide, or mixed nucleotide/non-nucleotide linker is used, for example, to attach a conjugate moiety to the siNA. In one embodiment, a nucleotide linker of the invention can be a linker of ≧2 nucleotides in length, for example about 3, 4, 5, 6, 7, 8, 9, or 10 nucleotides in length. In another embodiment, the nucleotide linker can be a nucleic acid aptamer. By "aptamer" or "nucleic acid aptamer" as used herein is meant a nucleic acid molecule that binds specifically to a target VEGF and/or VEGFR molecule wherein the nucleic acid molecule has sequence that comprises a sequence recognized by the target VEGF and/or VEGFR molecule in its natural setting. Alternately, an aptamer can be a nucleic acid molecule that binds to a target VEGF and/or VEGFR molecule where the target VEGF and/or VEGFR molecule does not naturally bind to a nucleic acid. The target VEGF and/or VEGFR molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. (See, for example, Gold et al., 1995, *Annu. Rev. Biochem.,* 64, 763; Brody and Gold, 2000, *J. Biotechnol.,* 74, 5; Sun, 2000, *Curr. Opin. Mol. Ther.,* 2, 100; Kusser, 2000, *J. Biotechnol.,* 74, 27; Hermann and Patel, 2000, *Science,* 287, 820; and Jayasena, 1999, *Clinical Chemistry,* 45, 1628.)

In yet another embodiment, a non-nucleotide linker of the invention comprises abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al., *Nucleic Acids Res.* 1993, 21:2585 and *Biochemistry* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al, International Publication No. WO 95/11910 and Ferentz and Verdine, *J. Am. Chem. Soc.* 1991, 113:4000, all hereby incorporated by reference herein. A "non-nucleotide" further means any group or compound that can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine, for example at the C1 position of the sugar.

In one embodiment, the invention features a short interfering nucleic acid (siNA) molecule capable of mediating RNA interference (RNAi) inside a cell or reconstituted in vitro system, wherein one or both strands of the siNA molecule that are assembled from two separate oligonucleotides do not comprise any ribonucleotides. For example, a siNA molecule can be assembled from a single oligonculeotide where the sense and antisense regions of the siNA comprise separate oligonucleotides that do not have any ribonucleotides (e.g., nucleotides having a 2'-OH group) present in the oligonucleotides. In another example, a siNA molecule can be assembled from a single oligonculeotide where the sense and antisense regions of the siNA are linked or circularized by a nucleotide or non-nucleotide linker as described herein, wherein the oligonucleotide does not have any ribonucleotides (e.g., nucleotides having a 2'-OH group) present in the oligonucleotide. Applicant has surprisingly found that the presense of ribonucleotides (e.g., nucleotides having a 2'-hydroxyl group) within the siNA molecule is not required or essential to support RNAi activity. As such, in one embodiment, all positions within the siNA can include chemically modified nucleotides and/or non-nucleotides such as nucleotides and or non-nucleotides having Formula I, II, III, IV, V, VI, or VII or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system comprising a single stranded polynucleotide having complementarity to a target VEGF and/or VEGFR nucleic acid sequence. In another embodiment, the single stranded siNA molecule of the invention comprises a 5'-terminal phosphate group. In another embodiment, the single stranded siNA molecule of the invention comprises a 5'-terminal phosphate group and a 3'-terminal phosphate group (e.g., a 2',3'-cyclic phosphate). In another embodiment, the single stranded siNA molecule of the invention comprises about 15 to about 30 (e.g., about 15, 16, 17, 18, 19, 20, 21, 22, 23, 24, 25, 26, 27, 28, 29, or 30) nucleotides. In yet another embodiment, the single stranded siNA molecule of the invention comprises one or more chemically modified nucleotides or non-nucleotides described herein. For example, all the positions within the siNA molecule can include chemically-modified nucleotides such as nucleotides having any of Formulae I-VII, or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system comprising a single stranded polynucleotide having complementarity to a target VEGF and/or VEGFR nucleic acid sequence, wherein one or more pyrimidine nucleotides present in the siNA are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and a terminal cap modification, such as any modification described herein or shown in FIG. 10, that is optionally present at the 3'-end, the 5'-end, or both of the 3' and 5'-ends of the antisense sequence. The siNA optionally further comprises about 1 to about 4 or more (e.g., about 1, 2, 3, 4 or more) terminal 2'-deoxynucleotides at the 3'-end of the siNA molecule, wherein the terminal nucleotides can further comprise one or more (e.g., 1, 2, 3, 4 or more) phosphorothioate, phosphonoacetate, and/or thiophosphonoacetate internucleotide linkages, and wherein the siNA optionally further comprises a terminal phosphate group, such as a 5'-terminal phosphate group. In any of these embodiments, any purine nucleotides present in the antisense region are alternatively 2'-deoxy purine nucleotides (e.g., wherein all purine nucleotides are 2'-deoxy purine nucleotides or alternately a plurality of purine nucleotides are 2'-deoxy purine nucleotides). Also, in any of these embodiments, any purine nucleotides present in the siNA (i.e., purine nucleotides present in the sense and/or antisense region) can alternatively be locked nucleic acid (LNA) nucleotides (e.g., wherein all purine nucleotides are LNA nucleotides or alternately a plurality of purine nucleotides are LNA nucleotides). Also, in any of these embodiments, any purine nucleotides present in the siNA are alternatively 2'-methoxyethyl purine nucleotides (e.g., wherein all purine nucleotides are 2'-methoxyethyl purine nucleotides or alternately a plurality of purine nucleotides are 2'-methoxyethyl purine nucleotides). In another embodiment, any modified nucleotides present in the single stranded siNA molecules of the invention comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984). As such, chemically modified nucleotides present in the single stranded siNA molecules of the invention are preferably resistant to nuclease degradation while at the same time maintaining the capacity to mediate RNAi.

In one embodiment, a siNA molecule of the invention comprises chemically modified nucleotides or non-nucleotides (e.g., having any of Formulae I-VII, such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides) at alternating positions within one or more strands or regions of the siNA molecule. For example, such chemical modifications can be introduced at every other position of a RNA based siNA molecule, starting at either the first or second nucleotide from the 3'-end or 5'-end of the siNA. In a non-limiting example, a double stranded siNA molecule of the invention in which each strand of the siNA is 21 nucleotides in length is featured wherein positions 1, 3, 5, 7, 9, 11, 13, 15, 17, 19 and 21 of each strand are chemically modified (e.g., with compounds having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides). In another non-limiting example, a double stranded siNA molecule of the invention in which each strand of the siNA is 21 nucleotides in length is featured wherein positions 2, 4, 6, 8, 10, 12, 14, 16, 18, and 20 of each strand are chemically modified (e.g., with compounds having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides). In one embodiment, one strand of the double stranded siNA molecule comprises chemical modifications at positions 2, 4, 6, 8, 10, 12, 14, 16, 18, and 20 and chemical modifications at positions 1, 3, 5, 7, 9, 11, 13, 15, 17, 19 and 21. Such siNA molecules can further comprise terminal cap moieties and/or backbone modifications as described herein.

In one embodiment, a siNA molecule of the invention comprises the following features: if purine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such purine nucleosides are ribonucleotides. In another embodiment, the purine ribonucleotides, when present, are base paired to nucleotides of the sense strand or sense region (otherwise referred to as the passenger strand) of the siNA molecule. Such purine ribonucleotides can be present in a siNA stabilization motif that otherwise comprises modified nucleotides.

In one embodiment, a siNA molecule of the invention comprises the following features: if pyrimidine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such pyrimidine nucleosides are ribonucleotides. In another embodiment, the pyrimidine ribonucleotides, when present, are base paired to nucleotides of the sense strand or sense region (otherwise referred to as the passenger strand) of the siNA molecule. Such pyrimidine ribonucleotides can be present in a siNA stabilization motif that otherwise comprises modified nucleotides.

In one embodiment, a siNA molecule of the invention comprises the following features: if pyrimidine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such pyrimidine nucleosides are modified nucleotides. In another embodiment, the modified pyrimidine nucleotides, when present, are base paired to nucleotides of the sense strand or sense region (otherwise referred to as the passenger strand) of the siNA molecule. Non-limiting examples of modified pyrimidine nucleotides include those having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides.

In one embodiment, the invention features a double stranded nucleic acid molecule having structure SI:

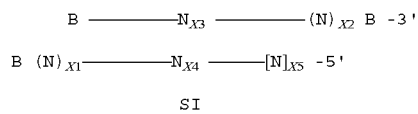

SI wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4;

X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SII:

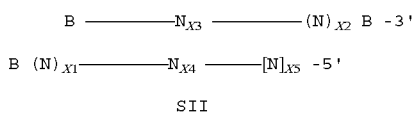

SII wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are ribonucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIII:

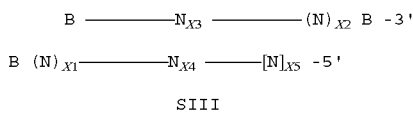

SIII wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIV:

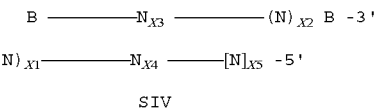

SIV wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are deoxyribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SV:

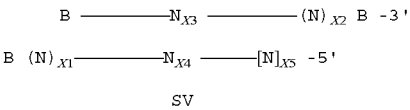

SV wherein each N is independently a nucleotide; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are nucleotides having a ribo-like configuration (e.g., Northern or A-form helix configuration); any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are nucleotides having a ribo-like configuration (e.g., Northern or A-form helix configuration); any purine nucleotides present in the sense strand (upper strand) are 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SVI:

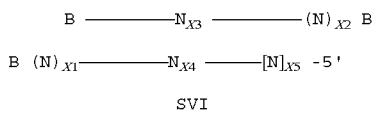

SVI wherein each N is independently a nucleotide; each B is a terminal cap moiety that can be present or absent; (N) represents non-base paired or overhanging nucleotides which can be unmodified or chemically modified; [N] represents nucleotide positions comprising sequence that renders the 5'-end of the antisense strand (lower strand) less thermally stable than the 5'-end of the sense strand (upper strand); X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SVII:

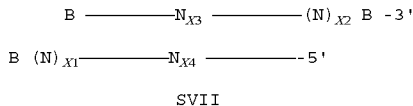

SVII wherein each N is independently a nucleotide; each B is a terminal cap moiety that can be present or absent; (N) represents non-base paired or overhanging nucleotides; X1 and X2 are independently integers from about 0 to about 4; X3 is an integer from about 9 to about 30; X4 is an integer from about 11 to about 36; NX3 is complementary to NX4, and any (N) nucleotides are 2'-O-methyl and/or 2'-deoxy-2'-fluoro nucleotides.

In one embodiment, the invention features a double stranded nucleic acid molecule having structure SVIII:

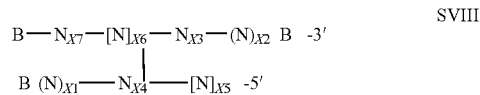

SVIII wherein each N is independently a nucleotide; each B is a terminal cap moiety that can be present or absent; (N) represents non-base paired or overhanging nucleotides which can be unmodified or chemically modified; [N] represents nucleotide positions comprising sequence that renders the 5'-end of the antisense strand (lower strand) less thermally stable than the 5'-end of the sense strand (upper strand); [N] represents nucleotide positions that are ribonucleotides; X1 and X2 are independently integers from about 0 to about 4; X3 is an integer from about 9 to about 15; X4 is an integer from about 11 to about 30, provided that the sum of X4 and X5 is between 17-36; X5 is an integer from about 1 to about 6; X6 is an integer from about 1 to about 4; X7 is an integer from about 9 to about 15; NX7, NX6, and NX3 are complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides other than [N] nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides other than [N] nucleotides; and (c) any (N) nucleotides are optionally 2'-O-methyl, 2'-deoxy-2'-fluoro, or deoxyribonucleotides.

In one embodiment, a double stranded nucleic acid molecule having any of structure SI, SII, SIII, SIV, SV, SVI, SVII or SVIII comprises a terminal phosphate group at the 5'-end of the antisense strand or antisense region of the nucleic acid molecule.

In one embodiment, a double stranded nucleic acid molecule having any of structure SI, SII, SIII, SIV, SV, SVI, SVII or SVIII comprises X5=1, 2, or 3; each XI and X2=1 or 2; X3=12, 13, 14, 15, 16, 17, 18, 19, 20, 21, 22, 23, 24, 25, 26, 27, 28, 29, or 30, and X4=15, 16, 17, 18, 19, 20, 21, 22, 23, 24, 25, 26, 27, 28, 29, or 30.

In one embodiment, a double stranded nucleic acid molecule having any of structure SI, SII, SIII, SIV, SV, SVI, SVII or SVIII comprises X5=1; each X1 and X2=2; X3=19, and X4=18.

In one embodiment, a double stranded nucleic acid molecule having any of structure SI, SII, SIII, SIV, SV, SVI, SVII or SVIII comprises X5=2; each X1 and X2=2; X3=19, and X4=17

In one embodiment, a double stranded nucleic acid molecule having any of structure SI, SII, SIII, SIV, SV, SVI, SVII or SVIII comprises X5=3; each X1 and X2=2; X3=19, and X4=16.

In one embodiment, a double stranded nucleic acid molecule having any of structure SI, SII, SIII, SIV, SV, SVI, SVII or SVIII comprises B at the 3' and 5' ends of the sense strand or sense region.

In one embodiment, a double stranded nucleic acid molecule having any of structure SI, SII, SIII, SIV, SV, SVI, SVII or SVIII comprises B at the 3'-end of the antisense strand or antisense region.

In one embodiment, a double stranded nucleic acid molecule having any of structure SI, SII, SII, SIV, SV, SVI, SVII or SVIII comprises B at the 3' and 5' ends of the sense strand or sense region and B at the 3'-end of the antisense strand or antisense region.

In one embodiment, a double stranded nucleic acid molecule having any of structure SI, SII, SIII, SIV, SV, SVI, SVII or SVIII further comprises one or more phosphorothioate internucleotide linkages at the first terminal (N) on the 3'end of the sense strand, antisense strand, or both sense strand and antisense strands of the nucleic acid molecule. For example, a double stranded nucleic acid molecule can comprise X1 and/or X2=2 having overhanging nucleotide positions with a phosphorothioate internucleotide linkage, e.g., (NsN) where "s" indicates phosphorothioate.

In one embodiment, a double stranded nucleic acid molecule having any of structure SI, SII, SIII, SIV, SV, SVI, SVII or SVIII comprises (N) nucleotides that are 2'-O-methyl nucleotides.

In one embodiment, a double stranded nucleic acid molecule having any of structure SI, SII, SIII, SIV, SV, SVI, SVII or SVIII comprises (N) nucleotides that are 2'-O-methyl nucleotides.

In one embodiment, a double stranded nucleic acid molecule having any of structure SI, SII, SIII, SIV, SV, SVI, SVII or SVIII comprises (N) nucleotides in the antisense strand (lower strand) that are complementary to nucleotides in a target VEGF and/or VEGFR polynucleotide sequence having complementary to the N and [N] nucleotides of the antisense (lower) strand.

In one embodiment, a double stranded nucleic acid molecule having any of structure SI, SII, SIII, SIV, SV, SVI, SVII or SVIII comprises (N) nucleotides in the sense strand (upper strand) that comprise nucleotide sequence corresponding a target VEGF and/or VEGFR polynucleotide sequence having complementary to the antisense (lower) strand such that the contiguous (N) and N nucleotide sequence of the sense strand comprises nucleotide sequence of the target VEGF and/or VEGFR nucleic acid sequence.

In one embodiment, a double stranded nucleic acid molecule having any of structure SVIII comprises B only at the 5'-end of the sense (upper) strand of the double stranded nucleic acid molecule.

In one embodiment, a double stranded nucleic acid molecule having any of structure SI, SII, SIII, SIV, SV, SVI, SVII or SVIII further comprises an unpaired terminal nucleotide at the 5'-end of the antisense (lower) strand. The unpaired nucleotide is not complementary to the sense (upper) strand. In one embodiment, the unpaired terminal nucleotide is complementary to a target VEGF and/or VEGFR polynucleotide sequence having complementary to the N and [N] nucleotides of the antisense (lower) strand. In another embodiment, the unpaired terminal nucleotide is not complementary to a target VEGF and/or VEGFR polynucleotide sequence having complementary to the N and [N] nucleotides of the antisense (lower) strand.

In one embodiment, a double stranded nucleic acid molecule having any of structure SVIII comprises X6=1 and X3=10.

In one embodiment, a double stranded nucleic acid molecule having any of structure SVIII comprises X6=2 and X3=9.

In one embodiment, the invention features a method for modulating the expression of a target VEGF and/or VEGFR gene within a cell comprising: (a) synthesizing a siNA molecule of the invention, which can be chemically-modified or unmodified, wherein one of the siNA strands comprises a sequence complementary to RNA of the target VEGF and/or VEGFR gene; and (b) introducing the siNA molecule into a cell under conditions suitable to modulate (e.g., inhibit) the expression of the target VEGF and/or VEGFR gene in the cell.

In one embodiment, the invention features a method for modulating the expression of a target VEGF and/or VEGFR gene within a cell comprising: (a) synthesizing a siNA molecule of the invention, which can be chemically-modified or unmodified, wherein one of the siNA strands comprises a sequence complementary to RNA of the target VEGF and/or VEGFR gene and wherein the sense strand sequence of the siNA comprises a sequence identical or substantially similar to the sequence of the target VEGF and/or VEGFR RNA; and (b) introducing the siNA molecule into a cell under conditions suitable to modulate (e.g., inhibit) the expression of the target VEGF and/or VEGFR gene in the cell.

In another embodiment, the invention features a method for modulating the expression of more than one target VEGF and/or VEGFR gene within a cell comprising: (a) synthesizing siNA molecules of the invention, which can be chemically-modified or unmodified, wherein one of the siNA strands comprises a sequence complementary to RNA of the target VEGF and/or VEGFR genes; and (b) introducing the siNA molecules into a cell under conditions suitable to modulate (e.g., inhibit) the expression of the target VEGF and/or VEGFR genes in the cell.

In another embodiment, the invention features a method for modulating the expression of two or more target VEGF and/or VEGFR genes within a cell comprising: (a) synthesizing one or more siNA molecules of the invention, which can be chemically-modified or unmodified, wherein the siNA strands comprise sequences complementary to RNA of the target VEGF and/or VEGFR genes and wherein the sense strand sequences of the siNAs comprise sequences identical or substantially similar to the sequences of the target VEGF and/or VEGFR RNAs; and (b) introducing the siNA molecules into a cell under conditions suitable to modulate (e.g., inhibit) the expression of the target VEGF and/or VEGFR genes in the cell.

In another embodiment, the invention features a method for modulating the expression of more than one target VEGF and/or VEGFR gene within a cell comprising: (a) synthesizing a siNA molecule of the invention, which can be chemically-modified or unmodified, wherein one of the siNA strands comprises a sequence complementary to RNA of the target VEGF and/or VEGFR gene and wherein the sense strand sequence of the siNA comprises a sequence identical or substantially similar to the sequences of the target VEGF and/or VEGFR RNAs; and (b) introducing the siNA molecule into a cell under conditions suitable to modulate (e.g., inhibit) the expression of the target VEGF and/or VEGFR genes in the cell.

In another embodiment, the invention features a method for modulating the expression of a target VEGF and/or VEGFR gene within a cell comprising: (a) synthesizing a siNA molecule of the invention, which can be chemically-modified or unmodified, wherein one of the siNA strands comprises a sequence complementary to RNA of the target VEGF and/or VEGFR gene, wherein the sense strand sequence of the siNA comprises a sequence identical or substantially similar to the sequences of the target VEGF and/or VEGFR RNA; and (b) introducing the siNA molecule into a cell under conditions suitable to modulate (e.g., inhibit) the expression of the target VEGF and/or VEGFR gene in the cell.

In one embodiment, siNA molecules of the invention are used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain target VEGF and/or VEGFR cells from a patient are extracted. These extracted cells are contacted with siNAs target VEGF and/or VEGFRing a specific nucleotide sequence within the cells under conditions suitable for uptake of the siNAs by these cells (e.g. using delivery reagents such as cationic lipids, liposomes and the like or using techniques such as electroporation to facilitate the delivery of siNAs into cells). The cells are then reintroduced back into the same patient or other patients.

In one embodiment, the invention features a method of modulating the expression of a target VEGF and/or VEGFR gene in a tissue explant comprising: (a) synthesizing a siNA molecule of the invention, which can be chemically-modified, wherein one of the siNA strands comprises a sequence complementary to RNA of the target VEGF and/or VEGFR gene; and (b) introducing the siNA molecule into a cell of the tissue explant derived from a particular organism under conditions suitable to modulate (e.g., inhibit) the expression of the target VEGF and/or VEGFR gene in the tissue explant. In another embodiment, the method further comprises introducing the tissue explant back into the organism the tissue was derived from or into another organism under conditions suitable to modulate (e.g., inhibit) the expression of the target VEGF and/or VEGFR gene in that organism.

In one embodiment, the invention features a method of modulating the expression of a target VEGF and/or VEGFR gene in a tissue explant comprising: (a) synthesizing a siNA molecule of the invention, which can be chemically-modified, wherein one of the siNA strands comprises a sequence complementary to RNA of the target VEGF and/or VEGFR gene and wherein the sense strand sequence of the siNA comprises a sequence identical or substantially similar to the sequence of the target VEGF and/or VEGFR RNA; and (b) introducing the siNA molecule into a cell of the tissue explant derived from a particular organism under conditions suitable to modulate (e.g., inhibit) the expression of the target VEGF and/or VEGFR gene in the tissue explant. In another embodiment, the method further comprises introducing the tissue explant back into the organism the tissue was derived from or into another organism under conditions suitable to modulate (e.g., inhibit) the expression of the target VEGF and/or VEGFR gene in that organism.

In another embodiment, the invention features a method of modulating the expression of more than one target VEGF and/or VEGFR gene in a tissue explant comprising: (a) synthesizing siNA molecules of the invention, which can be chemically-modified, wherein one of the siNA strands comprises a sequence complementary to RNA of the target VEGF and/or VEGFR genes; and (b) introducing the siNA molecules into a cell of the tissue explant derived from a particular organism under conditions suitable to modulate (e.g., inhibit) the expression of the target VEGF and/or VEGFR genes in the tissue explant. In another embodiment, the method further comprises introducing the tissue explant back into the organism the tissue was derived from or into another organism under conditions suitable to modulate (e.g., inhibit) the expression of the target VEGF and/or VEGFR genes in that organism.

In one embodiment, the invention features a method of modulating the expression of a target VEGF and/or VEGFR gene in a subject or organism comprising: (a) synthesizing a siNA molecule of the invention, which can be chemically-modified, wherein one of the siNA strands comprises a sequence complementary to RNA of the target VEGF and/or VEGFR gene; and (b) introducing the siNA molecule into the subject or organism under conditions suitable to modulate (e.g., inhibit) the expression of the target VEGF and/or VEGFR gene in the subject or organism. The level of target VEGF and/or VEGFR protein or RNA can be determined using various methods well-known in the art.

In another embodiment, the invention features a method of modulating the expression of more than one target VEGF and/or VEGFR gene in a subject or organism comprising: (a) synthesizing siNA molecules of the invention, which can be chemically-modified, wherein one of the siNA strands comprises a sequence complementary to RNA of the target VEGF and/or VEGFR genes; and (b) introducing the siNA molecules into the subject or organism under conditions suitable to modulate (e.g., inhibit) the expression of the target VEGF and/or VEGFR genes in the subject or organism. The level of target VEGF and/or VEGFR protein or RNA can be determined as is known in the art.

In one embodiment, the invention features a method for modulating the expression of a target VEGF and/or VEGFR gene within a cell comprising: (a) synthesizing a siNA molecule of the invention, which can be chemically-modified, wherein the siNA comprises a single stranded sequence having complementarity to RNA of the target VEGF and/or VEGFR gene; and (b) introducing the siNA molecule into a cell under conditions suitable to modulate (e.g., inhibit) the expression of the target VEGF and/or VEGFR gene in the cell.

In another embodiment, the invention features a method for modulating the expression of more than one target VEGF and/or VEGFR gene within a cell comprising: (a) synthesizing siNA molecules of the invention, which can be chemically-modified, wherein the siNA comprises a single stranded sequence having complementarity to RNA of the target VEGF and/or VEGFR gene; and (b) contacting the cell in vitro or in vivo with the siNA molecule under conditions suitable to modulate (e.g., inhibit) the expression of the target VEGF and/or VEGFR genes in the cell.

In one embodiment, the invention features a method of modulating the expression of a target VEGF and/or VEGFR gene in a tissue explant (e.g., a cochlea, skin, heart, liver, spleen, cornea, lung, stomach, kidney, vein, artery, hair, appendage, or limb transplant, or any other organ, tissue or cell as can be transplanted from one organism to another or back to the same organism from which the organ, tissue or cell is derived) comprising: (a) synthesizing a siNA molecule of the invention, which can be chemically-modified, wherein the siNA comprises a single stranded sequence having complementarity to RNA of the target VEGF and/or VEGFR gene; and (b) contacting a cell of the tissue explant derived from a particular subject or organism with the siNA molecule under conditions suitable to modulate (e.g., inhibit) the expression of the target VEGF and/or VEGFR gene in the tissue explant. In another embodiment, the method further comprises introducing the tissue explant back into the subject or organism the tissue was derived from or into another subject or organism under conditions suitable to modulate (e.g., inhibit) the expression of the target VEGF and/or VEGFR gene in that subject or organism.

In another embodiment, the invention features a method of modulating the expression of more than one target VEGF and/or VEGFR gene in a tissue explant (e.g., a cochlear, skin, heart, liver, spleen, cornea, lung, stomach, kidney, vein, artery, hair, appendage, or limb transplant, or any other organ, tissue or cell as can be transplanted from one organism to another or back to the same organism from which the organ, tissue or cell is derived) comprising: (a) synthesizing siNA molecules of the invention, which can be chemically-modified, wherein the siNA comprises a single stranded sequence having complementarity to RNA of the target VEGF and/or VEGFR gene; and (b) introducing the siNA molecules into a cell of the tissue explant derived from a particular subject or organism under conditions suitable to modulate (e.g., inhibit) the expression of the target VEGF and/or VEGFR genes in the tissue explant. In another embodiment, the method further comprises introducing the tissue explant back into the subject or organism the tissue was derived from or into another subject or organism under conditions suitable to modulate (e.g., inhibit) the expression of the target VEGF and/or VEGFR genes in that subject or organism.

In one embodiment, the invention features a method of modulating the expression of a target VEGF and/or VEGFR gene in a subject or organism comprising: (a) synthesizing a siNA molecule of the invention, which can be chemically-modified, wherein the siNA comprises a single stranded sequence having complementarity to RNA of the target VEGF and/or VEGFR gene; and (b) introducing the siNA molecule into the subject or organism under conditions suitable to modulate (e.g., inhibit) the expression of the target VEGF and/or VEGFR gene in the subject or organism.

In another embodiment, the invention features a method of modulating the expression of more than one target VEGF and/or VEGFR gene in a subject or organism comprising: (a) synthesizing siNA molecules of the invention, which can be chemically-modified, wherein the siNA comprises a single stranded sequence having complementarity to RNA of the target VEGF and/or VEGFR gene; and (b) introducing the siNA molecules into the subject or organism under conditions suitable to modulate (e.g., inhibit) the expression of the target VEGF and/or VEGFR genes in the subject or organism.

In one embodiment, the invention features a method of modulating the expression of a target VEGF and/or VEGFR gene in a subject or organism comprising contacting the subject or organism with a siNA molecule of the invention under conditions suitable to modulate (e.g., inhibit) the expression of the target VEGF and/or VEGFR gene in the subject or organism.

In one embodiment, the invention features a method for treating or preventing a disease, disorder, trait or condition related to gene expression in a subject or organism comprising contacting the subject or organism with a siNA molecule of the invention under conditions suitable to modulate the expression of the target gene in the subject or organism. The reduction of gene expression and thus reduction in the level of the respective protein/RNA relieves, to some extent, the symptoms of the disease, disorder, trait or condition.

In one embodiment, the invention features a method for treating or preventing ocular disease in a subject or organism comprising contacting the subject or organism with a siNA molecule of the invention under conditions suitable to modulate (e.g., inhibit) the expression of VEGF and/or VEGFR gene expression in the subject or organism. In one embodiment, the ocular disease is age related macular degeneration (e.g., wet or dry AMD). In one embodiment, the ocular disease is diabetic retinopathy.

In one embodiment, the invention features a method for treating or preventing cancer in a subject or organism comprising contacting the subject or organism with a siNA molecule of the invention under conditions suitable to modulate the expression of the target VEGF and/or VEGFR gene in the subject or organism whereby the treatment or prevention of cancer can be achieved. In one embodiment, the invention features contacting the subject or organism with a siNA molecule of the invention via local administration to relevant tissues or cells, such as cancerous cells and tissues. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of cancer in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of cancer in a subject or organism.

In one embodiment, the invention features a method for treating or preventing a proliferative disease or condition in a subject or organism comprising contacting the subject or organism with a siNA molecule of the invention under conditions suitable to modulate the expression of the target VEGF and/or VEGFR gene in the subject or organism whereby the treatment or prevention of the proliferative disease or condition can be achieved. In one embodiment, the invention features contacting the subject or organism with a siNA molecule of the invention via local administration to relevant tissues or cells, such as cells and tissues involved in proliferative disease. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the proliferative disease or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of proliferative diseases, traits, disorders, or conditions in a subject or organism.

In one embodiment, the invention features a method for treating or preventing an inflammatory disease or condition in a subject or organism comprising contacting the subject or organism with a siNA molecule of the invention under conditions suitable to modulate the expression of the target VEGF and/or VEGFR gene in the subject or organism whereby the treatment or prevention of the inflammatory disease or condition can be achieved. In one embodiment, the invention features contacting the subject or organism with a siNA molecule of the invention via local administration to relevant tissues or cells, such as cells and tissues involved in inflammatory disease. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the inflammatory disease or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of inflammatory diseases, traits, disorders, or conditions in a subject or organism.

In one embodiment, the invention features a method for treating or preventing an angiogenesis disease or condition in a subject or organism comprising contacting the subject or organism with a siNA molecule of the invention under conditions suitable to modulate the expression of the target VEGF and/or VEGFR gene in the subject or organism whereby the treatment or prevention of the angiogenesis disease or condition can be achieved. In one embodiment, the invention features contacting the subject or organism with a siNA molecule of the invention via local administration to relevant tissues or cells, such as cells and tissues involved in angiogenesis disease. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the angiogenesis disease or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of angiogenesis diseases, traits, disorders, or conditions in a subject or organism.

In one embodiment, the invention features a method for treating or preventing an autoimmune disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the autoimmune disease, disorder, trait or condition can be achieved. In one embodiment, the invention features contacting the subject or organism with a siNA molecule of the invention via local administration to relevant tissues or cells, such as cells and tissues involved in the autoimmune disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the autoimmune disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of autoimmune diseases, traits, disorders, or conditions in a subject or organism.

In one embodiment, the siNA molecule or double stranded nucleic acid molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.).

In one embodiment, the invention features a method for treating or preventing an age-related disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the age-related disease, disorder, trait or condition can be achieved. In one embodiment, the invention features contacting the subject or organism with a siNA molecule of the invention via local administration to relevant tissues or cells, such as cells and tissues involved in the age-related disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the age-related disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of age-related diseases, traits, disorders, or conditions in a subject or organism.

In one embodiment, the invention features a method for treating or preventing a neurologic or neurodegenerative disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the neurologic or neurodegenerative disease, disorder, trait or condition can be achieved. In one embodiment, the invention features contacting the subject or organism with a siNA molecule of the invention via local administration to relevant tissues or cells, such as cells and tissues involved in the neurologic or neurodegenerative disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the neurologic or neurodegenerative disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of neurologic or neurodegenerative diseases, traits, disorders, or conditions in a subject or organism.

In one embodiment, the invention features a method for treating or preventing a metabolic disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the metabolic disease, disorder, trait or condition can be achieved. In one embodiment, the invention features contacting the subject or organism with a siNA molecule of the invention via local administration to relevant tissues or cells, such as cells and tissues involved in the metabolic disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the metabolic disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of metabolic diseases, traits, disorders, or conditions in a subject or organism.

In one embodiment, the invention features a method for treating or preventing a cardiovascular disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the cardiovascular disease, disorder, trait or condition can be achieved. In one embodiment, the invention features contacting the subject or organism with a siNA molecule of the invention via local administration to relevant tissues or cells, such as cells and tissues involved in the cardiovascular disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the cardiovascular disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of cardiovascular diseases, traits, disorders, or conditions in a subject or organism.

In one embodiment, the invention features a method for treating or preventing a respiratory disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the respiratory disease, disorder, trait or condition can be achieved. In one embodiment, the invention features contacting the subject or organism with a siNA molecule of the invention via local administration to relevant tissues or cells, such as cells and tissues involved in the respiratory disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the respiratory disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of respiratory diseases, traits, disorders, or conditions in a subject or organism.

In one embodiment, the invention features a method for treating or preventing an ocular disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the ocular disease, disorder, trait or condition can be achieved. In one embodiment, the invention features contacting the subject or organism with a siNA molecule of the invention via local administration to relevant tissues or cells, such as cells and tissues involved in the ocular disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the ocular disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of ocular diseases, traits, disorders, or conditions in a subject or organism (e.g., age related macular degeneration, diabetic retinopathy etc.).

In one embodiment, the invention features a method for treating or preventing a dermatological disease, disorder, trait or condition in a subject or organism comprising contacting the subject or organism with a siNA molecule of the invention under conditions suitable to modulate the expression of the target VEGF and/or VEGFR gene in the subject or organism whereby the treatment or prevention of the dermatological disease, disorder, trait or condition can be achieved. In one embodiment, the invention features contacting the subject or organism with a siNA molecule of the invention via local administration to relevant tissues or cells, such as cells and tissues involved in the dermatological disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the dermatological disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of dermatological diseases, traits, disorders, or conditions in a subject or organism (e.g., rosacea, acne, dermatitis etc.).

In one embodiment, the invention features a method for treating or preventing a kidney/renal disease, disorder, trait or condition (e.g., polycystic kidney disease etc.) in a subject or organism comprising contacting the subject or organism with a siNA molecule of the invention under conditions suitable to modulate the expression of the target VEGF and/or VEGFR gene in the subject or organism whereby the treatment or prevention of the kidney/renal disease, disorder, trait or condition can be achieved. In one embodiment, the invention features contacting the subject or organism with a siNA molecule of the invention via local administration to relevant tissues or cells, such as kidney/renal cells and tissues involved in the kidney/renal disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the kidney/renal disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of kidney diseases, traits, disorders, or conditions in a subject or organism (e.g., polycystic kidney disease).

In one embodiment, the invention features a method for treating or preventing an auditory disease, disorder, trait or condition (e.g., hearing loss, deafness, etc.) in a subject or organism comprising contacting the subject or organism with a siNA molecule of the invention under conditions suitable to modulate the expression of the target VEGF and/or VEGFR gene in the subject or organism whereby the treatment or prevention of the auditory disease, disorder, trait or condition can be achieved. In one embodiment, the invention features contacting the subject or organism with a siNA molecule of the invention via local administration to relevant tissues or cells, such as cells and tissues of the ear, inner hear, or middle ear involved in the auditory disease, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the auditory disease, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of auditory diseases, traits, disorders, or conditions in a subject or organism.

In another embodiment, the siNA molecules of the invention are used to target conserved sequences corresponding to a gene family or gene families such as VEGF and/or VEGFR family genes. As such, siNA molecules targeting multiple VEGF and/or VEGFR targets can provide increased therapeutic effect. In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development. The invention can be used to understand pathways of gene expression involved in, for example, the progression and/or maintenance of cancer.

In any of the methods of treatment of the invention, the siNA can be administered to the subject as a course of treatment, for example administration at various time intervals, such as once per day over the course of treatment, once every two days over the course of treatment, once every three days over the course of treatment, once every four days over the course of treatment, once every five days over the course of treatment, once every six days over the course of treatment, once per week over the course of treatment, once every other week over the course of treatment, once per month over the course of treatment, etc. In one embodiment, the course of treatment is once every 1, 2, 3, 4, 5, 6, 7, 8, 9, or 10 weeks. In one embodiment, the course of treatment is from about one to about 52 weeks or longer (e.g., indefinitely). In one embodiment, the course of treatment is from about one to about 48 months or longer (e.g., indefinitely).

In one embodiment, a course of treatment involves an initial course of treatment, such as once every 1, 2, 3, 4, 5, 6, 7, 8, 9, 10 or more weeks for a fixed interval (e.g., 1×, 2×, 3×, 4×, 5×, 6×, 7×, 8×, 9×, 10× or more) followed by a maintenance course of treatment, such as once every 4, 6, 8, 10, 15, 20, 25, 30, 35, 40, or more weeks for an additional fixed interval (e.g., 1×, 2×, 3×, 4×, 5×, 6×, 7×, 8×, 9×, 10× or more).

In any of the methods of treatment of the invention, the siNA can be administered to the subject systemically as described herein or otherwise known in the art, either alone as a monotherapy or in combination with additional therapies as are known in the art. Systemic administration can include, for example, intravenous, subcutaneous, intramuscular, catheterization, nasopharangeal, transdermal, or gastrointestinal administration as is generally known in the art.

In one embodiment, in any of the methods of treatment or prevention of the invention, the siNA can be administered to the subject locally or to local tissues as described herein or otherwise known in the art, either alone as a monotherapy or in combination with additional therapies as are known in the art. Local administration can include, for example, catheterization, implantation, direct injection, dermal/transdermal application, stenting, ear/eye drops, or portal vein administration to relevant tissues, or any other local administration technique, method or procedure, as is generally known in the art.

The siNA molecules of the invention can be designed to down regulate or inhibit target (e.g., VEGF and/or VEGFR) gene expression through RNAi targeting of a variety of RNA molecules. In one embodiment, the siNA molecules of the invention are used to target various DNA corresponding to a target (e.g., VEGF and/or VEGFR) gene, for example via heterochromatic silencing or transcriptional inhibition. In one embodiment, the siNA molecules of the invention are used to target various RNAs corresponding to a target (e.g., VEGF and/or VEGFR) gene, for example via RNA target cleavage or translational inhibition. Non-limiting examples of such RNAs include messenger RNA (mRNA), non-coding RNA (ncRNA) or regulatory elements (see for example Mattick, 2005, *Science*, 309, 1527-1528 and Clayerie, 2005, *Science*, 309, 1529-1530) which includes miRNA and other small RNAs, alternate RNA splice variants of target gene(s), post-transcriptionally modified RNA of target gene(s), pre-mRNA of target gene(s), and/or RNA templates. If alternate splicing produces a family of transcripts that are distinguished by usage of appropriate exons, the instant invention can be used to inhibit gene expression through the appropriate exons to specifically inhibit or to distinguish among the functions of gene family members. For example, a protein that contains an alternatively spliced transmembrane domain can be expressed in both membrane bound and secreted forms. Use of the invention to target the exon containing the transmembrane domain can be used to determine the functional consequences of pharmaceutical targeting of membrane bound as opposed to the secreted form of the protein. Non-limiting examples of applications of the invention relating to targeting these RNA molecules include therapeutic pharmaceutical applications, cosmetic applications, veterinary applications, pharmaceutical discovery applications, molecular diagnostic and gene function applications, and gene mapping, for example using single nucleotide polymorphism mapping with siNA molecules of the invention. Such applications can be implemented using known gene sequences or from partial sequences available from an expressed sequence tag (EST).

In another embodiment, the siNA molecules of the invention are used to target conserved sequences corresponding to a gene family or gene families such as VEGF and/or VEGFR family genes. As such, siNA molecules targeting multiple VEGF and/or VEGFR targets can provide increased therapeutic effect. In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development. The invention can be used to understand pathways of gene expression involved in, for example, the progression and/or maintenance of cancer, angiogenesis, etc.

In one embodiment, siNA molecule(s) and/or methods of the invention are used to down regulate the expression of gene(s) that encode RNA referred to by Genbank Accession, for example, VEGF and/or VEGFR genes encoding RNA sequence(s) referred to herein by Genbank Accession number, for example, Genbank Accession Nos. shown in Table I or Genbank Accession Nos. shown in U.S. Ser. Nos. 10/923, 536 and 10/923,536, both incorporated by reference herein.

In one embodiment, the invention features a method comprising: (a) generating a library of siNA constructs having a predetermined complexity; and (b) assaying the siNA constructs of (a) above, under conditions suitable to determine RNAi target sites within the target RNA sequence. In one embodiment, the siNA molecules of (a) have strands of a fixed length, for example, about 23 nucleotides in length. In another embodiment, the siNA molecules of (a) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described herein. In another embodiment, the assay can comprise a cell culture system in which target RNA is expressed. In another embodiment, fragments of target RNA are analyzed for detectable levels of cleavage, for example by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In one embodiment, the invention features a method comprising: (a) generating a randomized library of siNA constructs having a predetermined complexity, such as of $4^N$, where N represents the number of base paired nucleotides in each of the siNA construct strands (eg. for a siNA construct having 21 nucleotide sense and antisense strands with 19 base pairs, the complexity would be $4^{19}$); and (b) assaying the siNA constructs of (a) above, under conditions suitable to determine RNAi target sites within the target RNA sequence. In another embodiment, the siNA molecules of (a) have strands of a fixed length, for example about 23 nucleotides in length. In yet another embodiment, the siNA molecules of (a) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described in Example 6 herein. In another embodiment, the assay can comprise a cell culture system in which target RNA is expressed. In another embodiment, fragments of target RNA are analyzed for detectable levels of cleavage, for example, by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In another embodiment, the invention features a method comprising: (a) analyzing the sequence of a RNA target encoded by a target gene; (b) synthesizing one or more sets of siNA molecules having sequence complementary to one or more regions of the RNA of (a); and (c) assaying the siNA molecules of (b) under conditions suitable to determine RNAi targets within the target RNA sequence. In one embodiment, the siNA molecules of (b) have strands of a fixed length, for example about 23 nucleotides in length. In another embodiment, the siNA molecules of (b) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described herein. In another embodiment, the assay can comprise a cell culture system in which target RNA is expressed. Fragments of target RNA are analyzed for detectable levels of cleavage, for example by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by expression in in vivo systems.

By "target site" is meant a sequence within a target RNA that is "targeted" for cleavage mediated by a siNA construct which contains sequences within its antisense region that are complementary to the target sequence.

By "detectable level of cleavage" is meant cleavage of target RNA (and formation of cleaved product RNAs) to an extent sufficient to discern cleavage products above the background of RNAs produced by random degradation of the target RNA. Production of cleavage products from 1-5% of the target RNA is sufficient to detect above the background for most methods of detection.

In one embodiment, the invention features a composition comprising a siNA molecule of the invention, which can be chemically-modified, in a pharmaceutically acceptable carrier or diluent. In another embodiment, the invention features a pharmaceutical composition comprising siNA molecules of the invention, which can be chemically-modified, targeting one or more genes in a pharmaceutically acceptable carrier or diluent. In another embodiment, the invention features a method for diagnosing a disease, trait, or condition in a subject comprising administering to the subject a composition of the invention under conditions suitable for the diagnosis of the disease, trait, or condition in the subject.

In another embodiment, the invention features a method for validating a VEGF and/or VEGFR target gene VEGF and/or VEGFR target, comprising: (a) synthesizing a siNA molecule of the invention, which can be chemically-modified, wherein one of the siNA strands includes a sequence complementary to RNA of a VEGF and/or VEGFR target gene; (b) introducing the siNA molecule into a cell, tissue, subject, or organism under conditions suitable for modulating expression of the VEGF and/or VEGFR target gene in the cell, tissue, subject, or organism; and (c) determining the function of the gene by assaying for any phenotypic change in the cell, tissue, subject, or organism.

In another embodiment, the invention features a method for validating a VEGF and/or VEGFR target comprising: (a) synthesizing a siNA molecule of the invention, which can be chemically-modified, wherein one of the siNA strands includes a sequence complementary to RNA of a VEGF and/or VEGFR target gene; (b) introducing the siNA molecule into a biological system under conditions suitable for modulating expression of the VEGF and/or VEGFR target gene in the biological system; and (c) determining the function of the gene by assaying for any phenotypic change in the biological system.

By "biological system" is meant, material, in a purified or unpurified form, from biological sources, including but not limited to human or animal, wherein the system comprises the components required for RNAi activity. The term "biological system" includes, for example, a cell, tissue, subject, or organism, or extract thereof. The term biological system also includes reconstituted RNAi systems that can be used in an in vitro setting.

By "phenotypic change" is meant any detectable change to a cell that occurs in response to contact or treatment with a nucleic acid molecule of the invention (e.g., siNA). Such detectable changes include, but are not limited to, changes in shape, size, proliferation, motility, protein expression or RNA expression or other physical or chemical changes as can be assayed by methods known in the art. The detectable change can also include expression of reporter genes/molecules such as Green Florescent Protein (GFP) or various tags that are used to identify an expressed protein or any other cellular component that can be assayed.

In one embodiment, the invention features a kit containing a siNA molecule of the invention, which can be chemically-modified, that can be used to modulate the expression of a VEGF and/or VEGFR target gene in a biological system, including, for example, in a cell, tissue, subject, or organism. In another embodiment, the invention features a kit containing more than one siNA molecule of the invention, which can be chemically-modified, that can be used to modulate the expression of more than one VEGF and/or VEGFR target gene in a biological system, including, for example, in a cell, tissue, subject, or organism.

In one embodiment, the invention features a cell containing one or more siNA molecules of the invention, which can be chemically-modified. In another embodiment, the cell containing a siNA molecule of the invention is a mammalian cell. In yet another embodiment, the cell containing a siNA molecule of the invention is a human cell.

In one embodiment, the synthesis of a siNA molecule of the invention, which can be chemically-modified, comprises: (a) synthesis of two complementary strands of the siNA molecule; (b) annealing the two complementary strands together under conditions suitable to obtain a double-stranded siNA molecule. In another embodiment, synthesis of the two complementary strands of the siNA molecule is by solid phase oligonucleotide synthesis. In yet another embodiment, synthesis of the two complementary strands of the siNA molecule is by solid phase tandem oligonucleotide synthesis.

In one embodiment, the invention features a method for synthesizing a siNA duplex molecule comprising: (a) synthesizing a first oligonucleotide sequence strand of the siNA molecule, wherein the first oligonucleotide sequence strand comprises a cleavable linker molecule that can be used as a scaffold for the synthesis of the second oligonucleotide sequence strand of the siNA; (b) synthesizing the second oligonucleotide sequence strand of siNA on the scaffold of the first oligonucleotide sequence strand, wherein the second oligonucleotide sequence strand further comprises a chemical moiety than can be used to purify the siNA duplex; (c) cleaving the linker molecule of (a) under conditions suitable for the two siNA oligonucleotide strands to hybridize and form a stable duplex; and (d) purifying the siNA duplex utilizing the chemical moiety of the second oligonucleotide sequence strand. In one embodiment, cleavage of the linker molecule in (c) above takes place during deprotection of the oligonucleotide, for example, under hydrolysis conditions using an alkylamine base such as methylamine. In one embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity as the solid support derivatized linker, such that cleavage of the solid support derivatized linker and the cleavable linker of (a) takes place concomitantly. In another embodiment, the chemical moiety of (b) that can be used to isolate the attached oligonucleotide sequence comprises a trityl group, for example a dimethoxytrityl group, which can be employed in a trityl-on synthesis strategy as described herein. In yet another embodiment, the chemical moiety, such as a dimethoxytrityl group, is removed during purification, for example, using acidic conditions.

In a further embodiment, the method for siNA synthesis is a solution phase synthesis or hybrid phase synthesis wherein both strands of the siNA duplex are synthesized in tandem using a cleavable linker attached to the first sequence which acts a scaffold for synthesis of the second sequence. Cleavage of the linker under conditions suitable for hybridization of the separate siNA sequence strands results in formation of the double-stranded siNA molecule.

In another embodiment, the invention features a method for synthesizing a siNA duplex molecule comprising: (a) synthesizing one oligonucleotide sequence strand of the siNA molecule, wherein the sequence comprises a cleavable linker molecule that can be used as a scaffold for the synthesis of another oligonucleotide sequence; (b) synthesizing a second oligonucleotide sequence having complementarity to the first sequence strand on the scaffold of (a), wherein the second sequence comprises the other strand of the double-stranded siNA molecule and wherein the second sequence further comprises a chemical moiety than can be used to isolate the attached oligonucleotide sequence; (c) purifying the product of (b) utilizing the chemical moiety of the second oligonucleotide sequence strand under conditions suitable for isolating the full-length sequence comprising both siNA oligonucleotide strands connected by the cleavable linker and under conditions suitable for the two siNA oligonucleotide strands to hybridize and form a stable duplex. In one embodiment, cleavage of the linker molecule in (c) above takes place during deprotection of the oligonucleotide, for example, under hydrolysis conditions. In another embodiment, cleavage of the linker molecule in (c) above takes place after deprotection of the oligonucleotide. In another embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity or differing reactivity as the solid support derivatized linker, such that cleavage of the solid support derivatized linker and the cleavable linker of (a) takes place either concomitantly or sequentially. In one embodiment, the chemical moiety of (b) that can be used to isolate the attached oligonucleotide sequence comprises a trityl group, for example a dimethoxytrityl group.

In another embodiment, the invention features a method for making a double-stranded siNA molecule in a single synthetic process comprising: (a) synthesizing an oligonucleotide having a first and a second sequence, wherein the first sequence is complementary to the second sequence, and the first oligonucleotide sequence is linked to the second sequence via a cleavable linker, and wherein a terminal 5'-protecting group, for example, a 5'-O-dimethoxytrityl group (5'-O-DMT) remains on the oligonucleotide having the second sequence; (b) deprotecting the oligonucleotide whereby the deprotection results in the cleavage of the linker joining the two oligonucleotide sequences; and (c) purifying the product of (b) under conditions suitable for isolating the double-stranded siNA molecule, for example using a trityl-on synthesis strategy as described herein.

In another embodiment, the method of synthesis of siNA molecules of the invention comprises the teachings of Scaringe et al., U.S. Pat. Nos. 5,889,136; 6,008,400; and 6,111,086, incorporated by reference herein in their entirety.

In one embodiment, the invention features siNA constructs that mediate RNAi against a VEGF and/or VEGFR target polynucleotide (e.g., RNA or DNA VEGF and/or VEGFR target), wherein the siNA construct comprises one or more chemical modifications, for example, one or more chemical modifications having any of Formulae I-VII or any combination thereof that increases the nuclease resistance of the siNA construct.

In another embodiment, the invention features a method for generating siNA molecules with increased nuclease resistance comprising (a) introducing nucleotides having any of Formula I-VII or any combination thereof into a siNA molecule, and (b) assaying the siNA molecule of step (a) under conditions suitable for isolating siNA molecules having increased nuclease resistance.

In another embodiment, the invention features a method for generating siNA molecules with improved toxicologic profiles (e.g., having attenuated or no immunstimulatory properties) comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules having improved toxicologic profiles.

In another embodiment, the invention features a method for generating siNA formulations with improved toxicologic profiles (e.g., having attenuated or no immunstimulatory properties) comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations having improved toxicologic profiles.

In another embodiment, the invention features a method for generating siNA molecules that do not stimulate an interferon response (e.g., no interferon response or attenuated interferon response) in a cell, subject, or organism, comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules that do not stimulate an interferon response.

In another embodiment, the invention features a method for generating siNA formulations that do not stimulate an interferon response (e.g., no interferon response or attenuated interferon response) in a cell, subject, or organism, comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations that do not stimulate an interferon response. In one embodiment, the interferon comprises interferon alpha.

In another embodiment, the invention features a method for generating siNA molecules that do not stimulate an inflammatory or proinflammatory cytokine response (e.g., no cytokine response or attenuated cytokine response) in a cell, subject, or organism, comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules that do not stimulate a cytokine response. In one embodiment, the cytokine comprises an interleukin such as interleukin-6 (IL-6) and/or tumor necrosis alpha (TNF-α).

In another embodiment, the invention features a method for generating siNA formulations that do not stimulate an inflammatory or proinflammatory cytokine response (e.g., no cytokine response or attenuated cytokine response) in a cell, subject, or organism, comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations that do not stimulate a cytokine response. In one embodiment, the cytokine comprises an interleukin such as interleukin-6 (IL-6) and/or tumor necrosis alpha (TNF-α).

In another embodiment, the invention features a method for generating siNA molecules that do not stimulate Toll-like Receptor (TLR) response (e.g., no TLR response or attenuated TLR response) in a cell, subject, or organism, comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules that do not stimulate a TLR response. In one embodiment, the TLR comprises TLR3, TLR7, TLR8 and/or TLR9.

In another embodiment, the invention features a method for generating siNA formulations that do not stimulate a Toll-like Receptor (TLR) response (e.g., no TLR response or attenuated TLR response) in a cell, subject, or organism, comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations that do not stimulate a TLR response. In one embodiment, the TLR comprises TLR3, TLR7, TLR8 and/or TLR9.

In one embodiment, the invention features a chemically synthesized double stranded short interfering nucleic acid (siNA) molecule that directs cleavage of a VEGF and/or VEGFR target RNA via RNA interference (RNAi), wherein: (a) each strand of said siNA molecule is about 18 to about 38 nucleotides in length; (b) one strand of said siNA molecule comprises nucleotide sequence having sufficient complementarity to said VEGF and/or VEGFR target RNA for the siNA molecule to direct cleavage of the VEGF and/or VEGFR target RNA via RNA interference; and (c) wherein the nucleotide positions within said siNA molecule are chemically modified to reduce the immunostimulatory properties of the siNA molecule to a level below that of a corresponding unmodified siRNA molecule. Such siNA molecules are said to have an improved toxicologic profile compared to an unmodified or minimally modified siNA.

By "improved toxicologic profile", is meant that the chemically modified or formulated siNA construct exhibits decreased toxicity in a cell, subject, or organism compared to an unmodified or unformulated siNA, or siNA molecule having fewer modifications or modifications that are less effective in imparting improved toxicology. In a non-limiting example, siNA molecules and formulations with improved toxicologic profiles are associated with reduced immunostimulatory properties, such as a reduced, decreased or attenuated immunostimulatory response in a cell, subject, or organism compared to an unmodified or unformulated siNA, or siNA molecule having fewer modifications or modifications that are less effective in imparting improved toxicology. Such an improved toxicologic profile is characterized by abrogated or reduced immunostimulation, such as reduction or abrogation of induction of interferons (e.g., interferon alpha), inflammatory cytokines (e.g., interleukins such as IL-6, and/or TNF-alpha), and/or toll like receptors (e.g., TLR-3, TLR-7, TLR-8, and/or TLR-9). In one embodiment, a siNA molecule or formulation with an improved toxicological profile comprises no ribonucleotides. In one embodiment, a siNA molecule or formulation with an improved toxicological profile comprises less than 5 ribonucleotides (e.g., 1, 2, 3, or 4 ribonucleotides). In one embodiment, a siNA molecule or formulation with an improved toxicological profile comprises Stab 7, Stab 8, Stab 11, Stab 12, Stab 13, Stab 16, Stab 17, Stab 18, Stab 19, Stab 20, Stab 23, Stab 24, Stab 25, Stab 26, Stab 27, Stab 28, Stab 29, Stab 30, Stab 31, Stab 32, Stab 33, Stab 34 or any combination thereof (see Table IV). Herein, numeric Stab chemistries include both 2'-fluoro and 2'-OCF3 versions of the chemistries shown in Table IV. For example, "Stab 7/8" refers to both Stab 7/8 and Stab 7F/8F etc. In one embodiment, a siNA molecule or formulation with an improved toxicological profile comprises a siNA molecule of the invention and a formulation as described in United States Patent Application Publication No. 20030077829, incorporated by reference herein in its entirety including the drawings.

In one embodiment, the level of immunostimulatory response associated with a given siNA molecule can be measured as is described herein or as is otherwise known in the art, for example by determining the level of PKR/interferon response, proliferation, B-cell activation, and/or cytokine production in assays to quantitate the immunostimulatory response of particular siNA molecules (see, for example, Leifer et al., 2003, *J Immunother.* 26, 313-9; and U.S. Pat. No. 5,968,909, incorporated in its entirety by reference). In one embodiment, the reduced immunostimulatory response is between about 10% and about 100% compared to an unmodified or minimally modified siRNA molecule, e.g., about 10%, 20%, 30%, 40%, 50%, 60%, 70%, 80%, 90% or 100% reduced immunostimulatory response. In one embodiment, the immunostimulatory response associated with a siNA molecule can be modulated by the degree of chemical modification. For example, a siNA molecule having between about 10% and about 100%, e.g., about 10%, 20%, 30%, 40%, 50%, 60%, 70%, 80%, 90% or 100% of the nucleotide positions in the siNA molecule modified can be selected to have a corresponding degree of immunostimulatory properties as described herein.

In one embodiment, the degree of reduced immunostimulatory response is selected for optimized RNAi activity. For example, retaining a certain degree of immunostimulation can be preferred to treat viral infection, where less than 100% reduction in immunostimulation may be preferred for maximal antiviral activity (e.g., about 10%, 20%, 30%, 40%, 50%, 60%, 70%, 80%, or 90% reduction in immunostimulation) whereas the inhibition of expression of an endogenous gene VEGF and/or VEGFR target may be preferred with siNA molecules that possess minimal immunostimulatory properties to prevent non-specific toxicity or off VEGF and/or VEGFR target effects (e.g., about 90% to about 100% reduction in immunostimulation).

In one embodiment, the invention features a chemically synthesized double stranded siNA molecule that directs cleavage of a VEGF and/or VEGFR target RNA via RNA interference (RNAi), wherein (a) each strand of said siNA molecule is about 18 to about 38 nucleotides in length; (b) one strand of said siNA molecule comprises nucleotide sequence having sufficient complementarity to said VEGF and/or VEGFR target RNA for the siNA molecule to direct cleavage of the VEGF and/or VEGFR target RNA via RNA interference; and (c) wherein one or more nucleotides of said siNA molecule are chemically modified to reduce the immunostimulatory properties of the siNA molecule to a level below that of a corresponding unmodified siNA molecule. In one embodiment, each strand comprises at least about 18 nucleotides that are complementary to the nucleotides of the other strand.

In another embodiment, the siNA molecule comprising modified nucleotides to reduce the immunostimulatory properties of the siNA molecule comprises an antisense region having nucleotide sequence that is complementary to a nucleotide sequence of a VEGF and/or VEGFR target gene or a portion thereof and further comprises a sense region, wherein said sense region comprises a nucleotide sequence substantially similar to the nucleotide sequence of said VEGF and/or VEGFR target gene or portion thereof. In one embodiment thereof, the antisense region and the sense region comprise about 18 to about 38 nucleotides, wherein said antisense region comprises at least about 18 nucleotides that are complementary to nucleotides of the sense region. In one embodiment thereof, the pyrimidine nucleotides in the sense region are 2'-O-methylpyrimidine nucleotides. In another embodiment thereof, the purine nucleotides in the sense region are 2'-deoxy purine nucleotides. In yet another embodiment thereof, the pyrimidine nucleotides present in the sense region are 2'-deoxy-2'-fluoro pyrimidine nucleotides. In another embodiment thereof, the pyrimidine nucleotides of said antisense region are 2'-deoxy-2'-fluoro pyrimidine nucleotides. In yet another embodiment thereof, the purine nucleotides of said antisense region are 2'-O-methyl purine nucleotides. In still another embodiment thereof, the purine nucleotides present in said antisense region comprise 2'-deoxypurine nucleotides. In another embodiment, the antisense region comprises a phosphorothioate internucleotide linkage at the 3' end of said antisense region. In another embodiment, the antisense region comprises a glyceryl modification at a 3' end of said antisense region.

In other embodiments, the siNA molecule comprising modified nucleotides to reduce the immunostimulatory properties of the siNA molecule can comprise any of the structural features of siNA molecules described herein. In other embodiments, the siNA molecule comprising modified nucleotides to reduce the immunostimulatory properties of the siNA molecule can comprise any of the chemical modifications of siNA molecules described herein.

In one embodiment, the invention features a method for generating a chemically synthesized double stranded siNA molecule having chemically modified nucleotides to reduce the immunostimulatory properties of the siNA molecule, comprising (a) introducing one or more modified nucleotides in the siNA molecule, and (b) assaying the siNA molecule of step (a) under conditions suitable for isolating an siNA molecule having reduced immunostimulatory properties compared to a corresponding siNA molecule having unmodified nucleotides. Each strand of the siNA molecule is about 18 to about 38 nucleotides in length. One strand of the siNA molecule comprises nucleotide sequence having sufficient complementarity to the VEGF and/or VEGFR target RNA for the siNA molecule to direct cleavage of the VEGF and/or VEGFR target RNA via RNA interference. In one embodiment, the reduced immunostimulatory properties comprise an abrogated or reduced induction of inflammatory or proinflammatory cytokines, such as interleukin-6 (IL-6) or tumor necrosis alpha (TNF-α), in response to the siNA being introduced in a cell, tissue, or organism. In another embodiment, the reduced immunostimulatory properties comprise an abrogated or reduced induction of Toll Like Receptors (TLRs), such as TLR3, TLR7, TLR8 or TLR9, in response to the siNA being introduced in a cell, tissue, or organism. In another embodiment, the reduced immunostimulatory properties comprise an abrogated or reduced induction of interferons, such as interferon alpha, in response to the siNA being introduced in a cell, tissue, or organism.

In one embodiment, the invention features siNA constructs that mediate RNAi against a VEGF and/or VEGFR target polynucleotide, wherein the siNA construct comprises one or more chemical modifications described herein that modulates the binding affinity between the sense and antisense strands of the siNA construct.

In another embodiment, the invention features a method for generating siNA molecules with increased binding affinity between the sense and antisense strands of the siNA molecule comprising (a) introducing nucleotides having any of Formula I-VII or any combination thereof into a siNA molecule, and (b) assaying the siNA molecule of step (a) under conditions suitable for isolating siNA molecules having increased binding affinity between the sense and antisense strands of the siNA molecule.

In one embodiment, the invention features siNA constructs that mediate RNAi against a VEGF and/or VEGFR target polynucleotide, wherein the siNA construct comprises one or more chemical modifications described herein that modulates the binding affinity between the antisense strand of the siNA construct and a complementary VEGF and/or VEGFR target RNA sequence within a cell.

In one embodiment, the invention features siNA constructs that mediate RNAi against a VEGF and/or VEGFR target polynucleotide, wherein the siNA construct comprises one or more chemical modifications described herein that modulates the binding affinity between the antisense strand of the siNA construct and a complementary VEGF and/or VEGFR target DNA sequence within a cell.

In another embodiment, the invention features a method for generating siNA molecules with increased binding affinity between the antisense strand of the siNA molecule and a complementary VEGF and/or VEGFR target RNA sequence comprising (a) introducing nucleotides having any of Formula I-VII or any combination thereof into a siNA molecule, and (b) assaying the siNA molecule of step (a) under conditions suitable for isolating siNA molecules having increased binding affinity between the antisense strand of the siNA molecule and a complementary VEGF and/or VEGFR target RNA sequence.

In another embodiment, the invention features a method for generating siNA molecules with increased binding affinity between the antisense strand of the siNA molecule and a complementary VEGF and/or VEGFR target DNA sequence comprising (a) introducing nucleotides having any of Formula I-VII or any combination thereof into a siNA molecule, and (b) assaying the siNA molecule of step (a) under conditions suitable for isolating siNA molecules having increased binding affinity between the antisense strand of the siNA molecule and a complementary VEGF and/or VEGFR target DNA sequence.

In one embodiment, the invention features siNA constructs that mediate RNAi against a VEGF and/or VEGFR target polynucleotide, wherein the siNA construct comprises one or more chemical modifications described herein that modulate the polymerase activity of a cellular polymerase capable of generating additional endogenous siNA molecules having sequence homology to the chemically-modified siNA construct.

In another embodiment, the invention features a method for generating siNA molecules capable of mediating increased polymerase activity of a cellular polymerase capable of generating additional endogenous siNA molecules having sequence homology to a chemically-modified siNA molecule comprising (a) introducing nucleotides having any of Formula I-VII or any combination thereof into a siNA molecule, and (b) assaying the siNA molecule of step (a) under conditions suitable for isolating siNA molecules capable of mediating increased polymerase activity of a cellular polymerase capable of generating additional endogenous siNA molecules having sequence homology to the chemically-modified siNA molecule.

In one embodiment, the invention features chemically-modified siNA constructs that mediate RNAi against a VEGF and/or VEGFR target polynucleotide in a cell, wherein the chemical modifications do not significantly effect the interaction of siNA with a VEGF and/or VEGFR target RNA molecule, DNA molecule and/or proteins or other factors that are essential for RNAi in a manner that would decrease the efficacy of RNAi mediated by such siNA constructs.

In another embodiment, the invention features a method for generating siNA molecules with improved RNAi specificity against polynucleotide VEGF and/or VEGFR targets comprising (a) introducing nucleotides having any of Formula I-VII or any combination thereof into a siNA molecule, and (b) assaying the siNA molecule of step (a) under conditions suitable for isolating siNA molecules having improved RNAi specificity. In one embodiment, improved specificity comprises having reduced off VEGF and/or VEGFR target effects compared to an unmodified siNA molecule. For example, introduction of terminal cap moieties at the 3'-end, 5'-end, or both 3' and 5'-ends of the sense strand or region of a siNA molecule of the invention can direct the siNA to have improved specificity by preventing the sense strand or sense region from acting as a template for RNAi activity against a corresponding VEGF and/or VEGFR target having complementarity to the sense strand or sense region.

In another embodiment, the invention features a method for generating siNA molecules with improved RNAi activity against a VEGF and/or VEGFR target polynucleotide comprising (a) introducing nucleotides having any of Formula I-VII or any combination thereof into a siNA molecule, and (b) assaying the siNA molecule of step (a) under conditions suitable for isolating siNA molecules having improved RNAi activity.

In yet another embodiment, the invention features a method for generating siNA molecules with improved RNAi activity against a VEGF and/or VEGFR target RNA comprising (a) introducing nucleotides having any of Formula I-VII or any combination thereof into a siNA molecule, and (b) assaying the siNA molecule of step (a) under conditions suitable for isolating siNA molecules having improved RNAi activity against the VEGF and/or VEGFR target RNA.

In yet another embodiment, the invention features a method for generating siNA molecules with improved RNAi activity against a VEGF and/or VEGFR target DNA comprising (a) introducing nucleotides having any of Formula I-VII or any combination thereof into a siNA molecule, and (b) assaying the siNA molecule of step (a) under conditions suitable for isolating siNA molecules having improved RNAi activity against the VEGF and/or VEGFR target DNA.

In one embodiment, the invention features siNA constructs that mediate RNAi against a VEGF and/or VEGFR target polynucleotide, wherein the siNA construct comprises one or more chemical modifications described herein that modulates the cellular uptake of the siNA construct, such as cholesterol conjugation of the siNA.

In another embodiment, the invention features a method for generating siNA molecules against a VEGF and/or VEGFR target polynucleotide with improved cellular uptake comprising (a) introducing nucleotides having any of Formula I-VII or any combination thereof into a siNA molecule, and (b) assaying the siNA molecule of step (a) under conditions suitable for isolating siNA molecules having improved cellular uptake.

In one embodiment, the invention features siNA constructs that mediate RNAi against a VEGF and/or VEGFR target polynucleotide, wherein the siNA construct comprises one or more chemical modifications described herein that increases the bioavailability of the siNA construct, for example, by attaching polymeric conjugates such as polyethyleneglycol or equivalent conjugates that improve the pharmacokinetics of the siNA construct, or by attaching conjugates that VEGF and/or VEGFR target specific tissue types or cell types in vivo. Non-limiting examples of such conjugates are described in Vargeese et al., U.S. Ser. No. 10/201,394 incorporated by reference herein.

In one embodiment, the invention features a method for generating siNA molecules of the invention with improved bioavailability comprising (a) introducing a conjugate into the structure of a siNA molecule, and (b) assaying the siNA molecule of step (a) under conditions suitable for isolating siNA molecules having improved bioavailability. Such conjugates can include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; cholesterol derivatives, polyamines, such as spermine or spermidine; and others.

In one embodiment, the invention features a double stranded short interfering nucleic acid (siNA) molecule that comprises a first nucleotide sequence complementary to a VEGF and/or VEGFR target RNA sequence or a portion thereof, and a second sequence having complementarity to said first sequence, wherein said second sequence is chemically modified in a manner that it can no longer act as a guide sequence for efficiently mediating RNA interference and/or be recognized by cellular proteins that facilitate RNAi. In one embodiment, the first nucleotide sequence of the siNA is chemically modified as described herein. In one embodiment, the first nucleotide sequence of the siNA is not modified (e.g., is all RNA).

In one embodiment, the invention features a double stranded short interfering nucleic acid (siNA) molecule that comprises a first nucleotide sequence complementary to a VEGF and/or VEGFR target RNA sequence or a portion thereof, and a second sequence having complementarity to said first sequence, wherein the second sequence is designed or modified in a manner that prevents its entry into the RNAi pathway as a guide sequence or as a sequence that is complementary to a VEGF and/or VEGFR target nucleic acid (e.g., RNA) sequence. In one embodiment, the first nucleotide sequence of the siNA is chemically modified as described herein. In one embodiment, the first nucleotide sequence of the siNA is not modified (e.g., is all RNA). Such design or modifications are expected to enhance the activity of siNA and/or improve the specificity of siNA molecules of the invention. These modifications are also expected to minimize any off-VEGF and/or VEGFR target effects and/or associated toxicity.

In one embodiment, the invention features a double stranded short interfering nucleic acid (siNA) molecule that comprises a first nucleotide sequence complementary to a VEGF and/or VEGFR target RNA sequence or a portion thereof, and a second sequence having complementarity to said first sequence, wherein said second sequence is incapable of acting as a guide sequence for mediating RNA interference. In one embodiment, the first nucleotide sequence of the siNA is chemically modified as described herein. In one embodiment, the first nucleotide sequence of the siNA is not modified (e.g., is all RNA).

In one embodiment, the invention features a double stranded short interfering nucleic acid (siNA) molecule that comprises a first nucleotide sequence complementary to a VEGF and/or VEGFR target RNA sequence or a portion thereof, and a second sequence having complementarity to said first sequence, wherein said second sequence does not have a terminal 5'-hydroxyl (5'-OH) or 5'-phosphate group.

In one embodiment, the invention features a double stranded short interfering nucleic acid (siNA) molecule that comprises a first nucleotide sequence complementary to a VEGF and/or VEGFR target RNA sequence or a portion thereof, and a second sequence having complementarity to said first sequence, wherein said second sequence comprises a terminal cap moiety at the 5'-end of said second sequence. In one embodiment, the terminal cap moiety comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a double stranded short interfering nucleic acid (siNA) molecule that comprises a first nucleotide sequence complementary to a VEGF and/or VEGFR target RNA sequence or a portion thereof, and a second sequence having complementarity to said first sequence, wherein said second sequence comprises a terminal cap moiety at the 5'-end and 3'-end of said second sequence. In one embodiment, each terminal cap moiety individually comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a method for generating siNA molecules of the invention with improved specificity for down regulating or inhibiting the expression of a VEGF and/or VEGFR target nucleic acid (e.g., a DNA or RNA such as a gene or its corresponding RNA), comprising (a) introducing one or more chemical modifications into the structure of a siNA molecule, and (b) assaying the siNA molecule of step (a) under conditions suitable for isolating siNA molecules having improved specificity. In another embodiment, the chemical modification used to improve specificity comprises terminal cap modifications at the 5'-end, 3'-end, or both 5' and 3'-ends of the siNA molecule. The terminal cap modifications can comprise, for example, structures shown in FIG. 10 (e.g. inverted deoxyabasic moieties) or any other chemical modification that renders a portion of the siNA molecule (e.g. the sense strand) incapable of mediating RNA interference against an off VEGF and/or VEGFR target nucleic acid sequence. In a non-limiting example, a siNA molecule is designed such that only the antisense sequence of the siNA molecule can serve as a guide sequence for RISC mediated degradation of a corresponding VEGF and/or VEGFR target RNA sequence. This can be accomplished by rendering the sense sequence of the siNA inactive by introducing chemical modifications to the sense strand that preclude recognition of the sense strand as a guide sequence by RNAi machinery. In one embodiment, such chemical modifications comprise any chemical group at the 5'-end of the sense strand of the siNA, or any other group that serves to render the sense strand inactive as a guide sequence for mediating RNA interference. These modifications, for example, can result in a molecule where the 5'-end of the sense strand no longer has a free 5'-hydroxyl (5'-OH) or a free 5'-phosphate group (e.g., phosphate, diphosphate, triphosphate, cyclic phosphate etc.). Non-limiting examples of such siNA constructs are described herein, such as "Stab 9/10", "Stab 7/8", "Stab 7/19", "Stab 17/22", "Stab 23/24", "Stab 24/25", and "Stab 24/26" (e.g., any siNA having Stab 7, 9, 17, 23, or 24 sense strands) chemistries and variants thereof (see Table IV) wherein the 5'-end and 3'-end of the sense strand of the siNA do not comprise a hydroxyl group or phosphate group. Herein, numeric Stab chemistries include both 2'-fluoro and 2'-OCF3 versions of the chemistries shown in Table IV. For example, "Stab 7/8" refers to both Stab 7/8 and Stab 7F/8F etc.

In one embodiment, the invention features a method for generating siNA molecules of the invention with improved specificity for down regulating or inhibiting the expression of a VEGF and/or VEGFR target nucleic acid (e.g., a DNA or RNA such as a gene or its corresponding RNA), comprising introducing one or more chemical modifications into the structure of a siNA molecule that prevent a strand or portion of the siNA molecule from acting as a template or guide sequence for RNAi activity. In one embodiment, the inactive strand or sense region of the siNA molecule is the sense strand or sense region of the siNA molecule, i.e. the strand or region of the siNA that does not have complementarity to the VEGF and/or VEGFR target nucleic acid sequence. In one embodiment, such chemical modifications comprise any chemical group at the 5'-end of the sense strand or region of the siNA that does not comprise a 5'-hydroxyl (5'-OH) or 5'-phosphate group, or any other group that serves to render the sense strand or sense region inactive as a guide sequence for mediating RNA interference. Non-limiting examples of such siNA constructs are described herein, such as "Stab 9/10", "Stab 7/8", "Stab 7/19", "Stab 17/22", "Stab. 23/24", "Stab 24/25", and "Stab 24/26" (e.g., any siNA having Stab 7, 9, 17, 23, or 24 sense strands) chemistries and variants thereof (see Table IV) wherein the 5'-end and 3'-end of the sense strand of the siNA do not comprise a hydroxyl group or phosphate group. Herein, numeric Stab chemistries include both 2'-fluoro and 2'-OCF3 versions of the chemistries shown in Table IV. For example, "Stab 7/8" refers to both Stab 7/8 and Stab 7F/8F etc.

In one embodiment, the invention features a method for screening siNA molecules that are active in mediating RNA interference against a VEGF and/or VEGFR target nucleic acid sequence comprising (a) generating a plurality of unmodified siNA molecules, (b) screening the siNA molecules of step (a) under conditions suitable for isolating siNA molecules that are active in mediating RNA interference against the VEGF and/or VEGFR target nucleic acid sequence, and (c) introducing chemical modifications (e.g. chemical modifications as described herein or as otherwise known in the art) into the active siNA molecules of (b). In one embodiment, the method further comprises re-screening the chemically modified siNA molecules of step (c) under conditions suitable for isolating chemically modified siNA molecules that are active in mediating RNA interference against the VEGF and/or VEGFR target nucleic acid sequence.

In one embodiment, the invention features a method for screening chemically modified siNA molecules that are active in mediating RNA interference against a VEGF and/or VEGFR target nucleic acid sequence comprising (a) generating a plurality of chemically modified siNA molecules (e.g. siNA molecules as described herein or as otherwise known in the art), and (b) screening the siNA molecules of step (a) under conditions suitable for isolating chemically modified siNA molecules that are active in mediating RNA interference against the VEGF and/or VEGFR target nucleic acid sequence.

The term "ligand" refers to any compound or molecule, such as a drug, peptide, hormone, or neurotransmitter, that is capable of interacting with another compound, such as a receptor, either directly or indirectly. The receptor that interacts with a ligand can be present on the surface of a cell or can alternately be an intercellular receptor. Interaction of the ligand with the receptor can result in a biochemical reaction, or can simply be a physical interaction or association.

In another embodiment, the invention features a method for generating siNA molecules of the invention with improved bioavailability comprising (a) introducing an excipient formulation to a siNA molecule, and (b) assaying the siNA molecule of step (a) under conditions suitable for isolating siNA molecules having improved bioavailability. Such excipients include polymers such as cyclodextrins, lipids, cationic lipids, polyamines, phospholipids, nanoparticles, receptors, ligands, and others.

In another embodiment, the invention features a method for generating siNA molecules of the invention with improved bioavailability comprising (a) introducing nucleotides having any of Formulae I-VII or any combination thereof into a siNA molecule, and (b) assaying the siNA molecule of step (a) under conditions suitable for isolating siNA molecules having improved bioavailability.

In another embodiment, polyethylene glycol (PEG) can be covalently attached to siNA compounds of the present invention. The attached PEG can be any molecular weight, preferably from about 100 to about 50,000 daltons (Da).

The present invention can be used alone or as a component of a kit having at least one of the reagents necessary to carry out the in vitro or in vivo introduction of RNA to test samples and/or subjects. For example, preferred components of the kit include a siNA molecule of the invention and a vehicle that promotes introduction of the siNA into cells of interest as described herein (e.g., using lipids and other methods of transfection known in the art, see for example Beigelman et al, U.S. Pat. No. 6,395,713). The kit can be used for VEGF and/or VEGFR target validation, such as in determining gene function and/or activity, or in drug optimization, and in drug discovery (see for example Usman et al., U.S. Ser. No.

60/402,996). Such a kit can also include instructions to allow a user of the kit to practice the invention.

The term "short interfering nucleic acid", "siNA", "short interfering RNA", "siRNA", "short interfering nucleic acid molecule", "short interfering oligonucleotide molecule", or "chemically-modified short interfering nucleic acid molecule" as used herein refers to any nucleic acid molecule capable of inhibiting or down regulating gene expression or viral replication by mediating RNA interference "RNAi" or gene silencing in a sequence-specific manner. For example the siNA can be a double-stranded nucleic acid molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The siNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure, for example wherein the double stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the siNA molecule are complementary to the target nucleic acid or a portion thereof). Alternatively, the siNA is assembled from a single oligonucleotide, where the self-complementary sense and antisense regions of the siNA are linked by means of a nucleic acid based or non-nucleic acid-based linker(s). The siNA can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single stranded polynucleotide having nucleotide sequence complementary to nucleotide sequence in a target nucleic acid molecule or a portion thereof (for example, where such siNA molecule does not require the presence within the siNA molecule of nucleotide sequence corresponding to the target nucleic acid sequence or a portion thereof), wherein the single stranded polynucleotide can further comprise a terminal phosphate group, such as a 5'-phosphate (see for example Martinez et al., 2002, Cell., 110, 563-574 and Schwarz et al., 2002, Molecular Cell, 10, 537-568), or 5',3'-diphosphate. In certain embodiments, the siNA molecule of the invention comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the siNA molecules of the invention comprise nucleotide sequence that is complementary to nucleotide sequence of a target gene. In another embodiment, the siNA molecule of the invention interacts with nucleotide sequence of a target gene in a manner that causes inhibition of expression of the target gene. As used herein, siNA molecules need not be limited to those molecules containing only RNA, but further encompasses chemically-modified nucleotides and non-nucleotides. In certain embodiments, the short interfering nucleic acid molecules of the invention lack 2'-hydroxy (2'-OH) containing nucleotides. Applicant describes in certain embodiments short interfering nucleic acids that do not require the presence of nucleotides having a 2'-hydroxy group for mediating RNAi and as such, short interfering nucleic acid molecules of the invention optionally do not include any ribonucleotides (e.g., nucleotides having a 2'-OH group). Such siNA molecules that do not require the presence of ribonucleotides within the siNA molecule to support RNAi can however have an attached linker or linkers or other attached or associated groups, moieties, or chains containing one or more nucleotides with 2'-OH groups. Optionally, siNA molecules can comprise ribonucleotides at about 5, 10, 20, 30, 40, or 50% of the nucleotide positions. The modified short interfering nucleic acid molecules of the invention can also be referred to as short interfering modified oligonucleotides "siMON." As used herein, the term siNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. Non limiting examples of siNA molecules of the invention are shown in FIGS. 4-6, and Table II herein. Such siNA molecules are distinct from other nucleic acid technologies known in the art that mediate inhibition of gene expression, such as ribozymes, antisense, triplex forming, aptamer, 2,5-A chimera, or decoy oligonucleotides.

By "RNA interference" or "RNAi" is meant a biological process of inhibiting or down regulating gene expression in a cell as is generally known in the art and which is mediated by short interfering nucleic acid molecules, see for example Zamore and Haley, 2005, *Science,* 309, 1519-1524; Vaughn and Martienssen, 2005, *Science,* 309, 1525-1526; Zamore et al., 2000, *Cell,* 101, 25-33; Bass, 2001, *Nature,* 411, 428-429; Elbashir et al., 2001, *Nature,* 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science,* 297, 1818-1819; Volpe et al., 2002, *Science,* 297, 1833-1837; Jenuwein, 2002, *Science,* 297, 2215-2218; and Hall et al., 2002, *Science,* 297, 2232-2237; Hutvagner and Zamore, 2002, *Science,* 297, 2056-60; McManus et al., 2002, *RNA,* 8, 842-850; Reinhart et al., 2002, *Gene & Dev.,* 16, 1616-1626; and Reinhart & Bartel, 2002, *Science,* 297, 1831). In addition, as used herein, the term RNAi is meant to be equivalent to other terms used to describe sequence specific RNA interference, such as post transcriptional gene silencing, translational inhibition, transcriptional inhibition, or epigenetics. For example, siNA molecules of the invention can be used to epigenetically silence genes at both the post-transcriptional level or the pre-transcriptional level. In a non-limiting example, epigenetic modulation of gene expression by siNA molecules of the invention can result from siNA mediated modification of chromatin structure or methylation patterns to alter gene expression (see, for example, Verdel et al., 2004, *Science,* 303, 672-676; Pal-Bhadra et al., 2004, *Science,* 303, 669-672; Allshire, 2002, *Science,* 297, 1818-1819; Volpe et al., 2002, *Science,* 297, 1833-1837; Jenuwein, 2002, *Science,* 297, 2215-2218; and Hall et al., 2002, *Science,* 297, 2232-2237). In another non-limiting example, modulation of gene expression by siNA molecules of the invention can result from siNA mediated cleavage of RNA (either coding or non-coding RNA) via RISC, or alternately, translational inhibition as is known in the art. In another embodiment, modulation of gene expression by siNA molecules of the invention can result from transcriptional inhibition (see for example Janowski et al., 2005, *Nature Chemical Biology,* 1, 216-222).

In one embodiment, a siNA molecule of the invention is a duplex forming oligonucleotide "DFO", (see for example FIGS. 14-15 and Vaish et al., U.S. Ser. No. 10/727,780 filed Dec. 3, 2003 and International PCT Application No. US04/16390, filed May 24, 2004).

In one embodiment, a siNA molecule of the invention is a multifunctional siNA, (see for example FIGS. 16-21 and Jadhav et al., U.S. Ser. No. 60/543,480 filed Feb. 10, 2004 and International PCT Application No. US04/16390, filed May 24, 2004). In one embodiment, the multifunctional siNA of the invention can comprise sequence targeting, for example, two or more regions of target RNA (see for example target sequences in Table II). In one embodiment, the multifunctional siNA of the invention can comprise sequence targeting one or more VEGF isoforms (e.g., VEGF-A, VEGF-B, VEGF-C, and/or VEGF-D). In one embodiment, the multifunctional siNA of the invention can comprise sequence targeting one or more VEGF receptors (e.g., VEGFR1, VEGFR2, and/or VEGFR3). In one embodiment, the multifunctional siNA of the invention can comprise sequence targeting one or more VEGF isoforms (e.g., VEGF-A, VEGF-B, VEGF-C, and/or VEGF-D) and one or more VEGF receptors, (e.g., VEGFR1, VEGFR2, and/or VEGFR3). In one embodiment, the multifunctional siNA of the invention can comprise sequence targeting one or more VEGF isoforms (e.g., VEGF-A, VEGF-B, VEGF-C, and/or VEGF-D) and one or more interleukins (e.g., IL-4 or IL-13) or one or more interleukin receptors (e.g., IL-4R or IL-13R). In one embodiment, the multifunctional siNA of the invention can comprise sequence targeting one or more VEGF receptors (e.g., VEGFR1, VEGFR2, and/or VEGFR3) and one or more interleukins (e.g., IL-4 or IL-13) or one or more interleukin receptors (e.g., IL-4R or IL-13R). In one embodiment, the multifunctional siNA of the invention can comprise sequence targeting one or more VEGF isoforms (e.g., VEGF-A, VEGF-B, VEGF-C, and/or VEGF-D), one or more VEGF receptors (e.g., VEGFR1, VEGFR2, and/or VEGFR3) and one or more interleukins (e.g., IL-4 or IL-13) or one or more interleukin receptors (e.g., IL-4R or IL-13R).

By "asymmetric hairpin" as used herein is meant a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 15 to about 30, or about 15, 16, 17, 18, 19, 20, 21, 22, 23, 24, 25, 26, 27, 28, 29, or 30 nucleotides) and a loop region comprising about 4 to about 12 (e.g., about 4, 5, 6, 7, 8, 9, 10, 11, or 12) nucleotides, and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

By "asymmetric duplex" as used herein is meant a siNA molecule having two separate strands comprising a sense region and an antisense region, wherein the sense region comprises fewer nucleotides than the antisense region to the extent that the sense region has enough complementary nucleotides to base pair with the antisense region and form a duplex. For example, an asymmetric duplex siNA molecule of the invention can comprise an antisense region having length sufficient to mediate RNAi in a cell or in vitro system (e.g., about 15 to about 30, or about 15, 16, 17, 18, 19, 20, 21, 22, 23, 24, 25, 26, 27, 28, 29, or 30 nucleotides) and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region.

By "modulate" is meant that the expression of the gene, or level of a RNA molecule or equivalent RNA molecules encoding one or more proteins or protein subunits, or activity of one or more proteins or protein subunits is up regulated or down regulated, such that expression, level, or activity is greater than or less than that observed in the absence of the modulator. For example, the term "modulate" can mean "inhibit," but the use of the word "modulate" is not limited to this definition.

By "inhibit", "down-regulate", or "reduce", it is meant that the expression of the gene, or level of RNA molecules or equivalent RNA molecules encoding one or more proteins or protein subunits, or activity of one or more proteins or protein subunits, is reduced below that observed in the absence of the nucleic acid molecules (e.g., siNA) of the invention. In one embodiment, inhibition, down-regulation or reduction with an siNA molecule is below that level observed in the presence of an inactive or attenuated molecule. In another embodiment, inhibition, down-regulation, or reduction with siNA molecules is below that level observed in the presence of, for example, an siNA molecule with scrambled sequence or with mismatches. In another embodiment, inhibition, down-regulation, or reduction of gene expression with a nucleic acid molecule of the instant invention is greater in the presence of the nucleic acid molecule than in its absence. In one embodiment, inhibition, down regulation, or reduction of gene expression is associated with post transcriptional silencing, such as RNAi mediated cleavage of a target nucleic acid molecule (e.g. RNA) or inhibition of translation. In one embodiment, inhibition, down regulation, or reduction of gene expression is associated with pretranscriptional silencing, such as by alterations in DNA methylation patterns and DNA chromatin structure.

By "up-regulate", or "promote", it is meant that the expression of the gene, or level of RNA molecules or equivalent RNA molecules encoding one or more proteins or protein subunits, or activity of one or more proteins or protein subunits, is increased above that observed in the absence of the nucleic acid molecules (e.g., siNA) of the invention. In one embodiment, up-regulation or promotion of gene expression with an siNA molecule is above that level observed in the presence of an inactive or attenuated molecule. In another embodiment, up-regulation or promotion of gene expression with siNA molecules is above that level observed in the presence of, for example, an siNA molecule with scrambled sequence or with mismatches. In another embodiment, up-regulation or promotion of gene expression with a nucleic acid molecule of the instant invention is greater in the presence of the nucleic acid molecule than in its absence. In one embodiment, up-regulation or promotion of gene expression is associated with inhibition of RNA mediated gene silencing, such as RNAi mediated cleavage or silencing of a coding or non-coding RNA target that down regulates, inhibits, or silences the expression of the gene of interest to be up-regulated. The down regulation of gene expression can, for example, be induced by a coding RNA or its encoded protein, such as through negative feedback or antagonistic effects. The down regulation of gene expression can, for example, be induced by a non-coding RNA having regulatory control over a gene of interest, for example by silencing expression of the gene via translational inhibition, chromatin structure, methylation, RISC mediated RNA cleavage, or translational inhibition. As such, inhibition or down regulation of targets that down regulate, suppress, or silence a gene of interest can be used to up-regulate or promote expression of the gene of interest toward therapeutic use.

By "gene", or "target gene" or "target DNA", is meant a nucleic acid that encodes an RNA, for example, nucleic acid sequences including, but not limited to, structural genes encoding a polypeptide. A gene or target gene can also encode a functional RNA (fRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of FRNA or ncRNA involved in functional or regulatory cellular processes. Aberrant fRNA or ncRNA activity leading to disease can therefore be modulated by siNA molecules of the invention. siNA molecules targeting fRNA and ncRNA can also be used to manipulate or alter the genotype or phenotype of a subject, organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, *Science*, 300, 258-260.

By "non-canonical base pair" is meant any non-Watson Crick base pair, such as mismatches and/or wobble base pairs, including flipped mismatches, single hydrogen bond mismatches, trans-type mismatches, triple base interactions, and quadruple base interactions. Non-limiting examples of such non-canonical base pairs include, but are not limited to, AC reverse Hoogsteen, AC wobble, AU reverse Hoogsteen, GU wobble, AA N7 amino, CC 2-carbonyl-amino(H1)-N-3-amino(H2), GA sheared, UC 4-carbonyl-amino, UU imino-carbonyl, AC reverse wobble, AU Hoogsteen, AU reverse Watson Crick, CG reverse Watson Crick, GC N3-amino-amino N3, AA N1-amino symmetric, AA N7-amino symmetric, GA N7-N1 amino-carbonyl, GA+carbonyl-amino N7-N1, GG N1-carbonyl symmetric, GG N3-amino symmetric, CC carbonyl-amino symmetric, CC N3-amino symmetric, UU 2-carbonyl-imino symmetric, UU 4-carbonyl-imino symmetric, AA amino-N3, AA N1-amino, AC amino 2-carbonyl, AC N3-amino, AC N7-amino, AU amino-4-carbonyl, AU N1-imino, AU N3-imino, AU N7-imino, CC carbonyl-amino, GA amino-N1, GA amino-N7, GA carbonyl-amino, GA N3-amino, GC amino-N3, GC carbonyl-amino, GC N3-amino, GC N7-amino, GG amino-N7, GG carbonyl-imino, GG N7-amino, GU amino-2-carbonyl, GU carbonyl-imino, GU imino-2-carbonyl, GU N7-imino, psiU imino-2-carbonyl, UC 4-carbonyl-amino, UC imino-carbonyl, UU imino-4-carbonyl, AC C2-H-N3, GA carbonyl-C2-H, UU imino-4-carbonyl 2 carbonyl-C5-H, AC amino(A) N3(C)-carbonyl, GC imino amino-carbonyl, Gpsi imino-2-carbonyl amino-2carbonyl, and GU imino amino-2-carbonyl base pairs.

By "target" as used herein is meant, any target protein, peptide, or polypeptide, such as encoded by Genbank Accession Nos. shown in Table I or in U.S. Ser. Nos. 10/923,536 and 10/923,536, both incorporated by reference herein. The term "target" also refers to nucleic acid sequences or target polynucleotide sequence encoding any target protein, peptide, or polypeptide, such as proteins, peptides, or polypeptides encoded by sequences having Genbank Accession Nos. shown in U.S. Ser. Nos. 10/923,536 and 10/923,536. The target of interest can include target polynucleotide sequences, such as target DNA or target RNA. The term "target" is also meant to include other sequences, such as differing isoforms, mutant target genes, splice variants of target polynucleotides, target polymorphisms, and non-coding (e.g., ncRNA, miRNA, sRNA) or other regulatory polynucleotide sequences as described herein. Therefore, in various embodiments of the invention, a double stranded nucleic acid molecule of the invention (e.g., siNA) having complementarity to a target RNA can be used to inhibit or down regulate miRNA or other ncRNA activity. In one embodiment, inhibition of miRNA or ncRNA activity can be used to down regulate or inhibit gene expression (e.g., gene targets described herein or otherwise known in the art) or viral replication (e.g., viral targets described herein or otherwise known in the art) that is dependent on miRNA or ncRNA activity. In another embodiment, inhibition of miRNA or ncRNA activity by double stranded nucleic acid molecules of the invention (e.g. siNA) having complementarity to the miRNA or ncRNA can be used to up regulate or promote target gene expression (e.g., gene targets described herein or otherwise known in the art) where the expression of such genes is down regulated, suppressed, or silenced by the miRNA or ncRNA. Such up-regulation of gene expression can be used to treat diseases and conditions associated with a loss of function or haploinsufficiency as are generally known in the art. In one embodiment, the target is a VEGF and/or VEGFR target, such as a VEGF and/or VEGFR polynucleotide target.

By "VEGF" as used herein is meant, any vascular endothelial growth factor (e.g., VEGF, VEGF-A, VEGF-B, VEGF-C, VEGF-D) protein, peptide, or polypeptide having vascular endothelial growth factor activity, such as encoded by VEGF Genbank Accession Nos. shown in Table I. The term VEGF also refers to nucleic acid sequences encoding any vascular endothelial growth factor protein, peptide, or polypeptide having vascular endothelial growth factor activity.

By "VEGF-B" is meant, protein, peptide, or polypeptide receptor or a derivative thereof, such as encoded by Genbank Accession No. NM_003377, having vascular endothelial growth factor type B activity. The term VEGF-B also refers to nucleic acid sequences encoding any VEGF-B protein, peptide, or polypeptide having VEGF-B activity.

By "VEGF-C" is meant, protein, peptide, or polypeptide receptor or a derivative thereof, such as encoded by Genbank Accession No. NM_005429, having vascular endothelial growth factor type C activity. The term VEGF-C also refers to nucleic acid sequences encoding any VEGF-C protein, peptide, or polypeptide having VEGF-C activity.

By "VEGF-D" is meant, protein, peptide, or polypeptide receptor or a derivative thereof, such as encoded by Genbank Accession No. NM_004469, having vascular endothelial growth factor type D activity. The term VEGF-D also refers to nucleic acid sequences encoding any VEGF-D protein, peptide, or polypeptide having VEGF-D activity.

By "VEGFR" as used herein is meant, any vascular endothelial growth factor receptor protein, peptide, or polypeptide (e.g., VEGFR1, VEGFR2, or VEGFR3, including both membrane bound and/or soluble forms thereof) having vascular endothelial growth factor receptor activity, such as encoded by VEGFR Genbank Accession Nos. shown in Table I. The term VEGFR also refers to nucleic acid sequences encoding any vascular endothelial growth factor receptor protein, peptide, or polypeptide having vascular endothelial growth factor receptor activity.

By "VEGFR1" is meant, protein, peptide, or polypeptide receptor or a derivative thereof, such as encoded by Genbank Accession No. NM_002019, having vascular endothelial growth factor receptor type 1 (flt) activity, for example, having the ability to bind a vascular endothelial growth factor. The term VEGF1 also refers to nucleic acid sequences encoding any VEGFR1 protein, peptide, or polypeptide having VEGFR1 activity.

By "VEGFR2" is meant, protein, peptide, or polypeptide receptor or a derivative thereof, such as encoded by Genbank Accession No. NM_002253, having vascular endothelial growth factor receptor type 2 (kdr) activity, for example, having the ability to bind a vascular endothelial growth factor. The term VEGF2 also refers to nucleic acid sequences encoding any VEGFR2 protein, peptide, or polypeptide having VEGFR2 activity.

By "VEGFR3" is meant, protein, peptide, or polypeptide receptor or a derivative thereof, such as encoded by Genbank Accession No. NM_002020 having vascular endothelial growth factor receptor type 3 (kdr) activity, for example, having the ability to bind a vascular endothelial growth factor. The term VEGFR3 also refers to nucleic acid sequences encoding any VEGFR3 protein, peptide, or polypeptide having VEGFR3 activity.

By "interleukin" is meant, any interleukin (e.g., IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, and IL-27) protein, peptide, or polypeptide having any interleukin activity, such as encoded by interleukin Genbank Accession Nos. described in U.S. Ser. No. 10/922,675, filed Aug. 20, 2004 and incorporated by reference herein in its entirety including the drawings. The term interleukin also refers to nucleic acid sequences encoding any interleukin protein, peptide, or polypeptide having interleukin activity. The term "interleukin" is also meant to include other interleukin encoding sequence, such as other interleukin isoforms, mutant interleukin genes, splice variants of interleukin genes, and interleukin gene polymorphisms.

By "interleukin receptor" is meant, any interleukin receptor (e.g., IL-1R, IL-2R, IL-3R, IL-4R, IL-5R, IL-6R, IL-7R, IL-8R, IL-9R, IL-10R, IL-11R, IL-12R, IL-13R, IL-14R, IL-15R, IL-16R, IL-17R, IL-18R, IL-19R, IL-20R, IL-21R, IL-22R, IL-23R, IL-24R, IL-25R, IL-26R, and IL-27R) protein, peptide, or polypeptide having any interleukin receptor activity, such as encoded by interleukin receptor Genbank Accession Nos. described in U.S. Ser. No. 10/922,675, filed Aug. 20, 2004 and incorporated by reference herein in its entirety including the drawings. The term interleukin receptor also refers to nucleic acid sequences encoding any interleukin receptor protein, peptide, or polypeptide having interleukin receptor activity. The term "interleukin receptor" is also meant to include other interleukin receptor encoding sequence, such as other interleukin receptor isoforms, mutant interleukin receptor genes, splice variants of interleukin receptor genes, and interleukin receptor gene polymorphisms.

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.).

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a siNA molecule having complementarity to an antisense region of the siNA molecule. In addition, the sense region of a siNA molecule can comprise a nucleic acid sequence having homology with a target nucleic acid sequence. In one embodiment, the sense region of the siNA molecule is referred to as the sense strand or passenger strand.

By "antisense region" is meant a nucleotide sequence of a siNA molecule having complementarity to a target nucleic acid sequence. In addition, the antisense region of a siNA molecule can optionally comprise a nucleic acid sequence having complementarity to a sense region of the siNA molecule. In one embodiment, the antisense region of the siNA molecule is referred to as the antisense strand or guide strand.

By "target nucleic acid" or "target polynucleotide" is meant any nucleic acid sequence whose expression or activity is to be modulated. The target nucleic acid can be DNA or RNA. In one embodiment, a target nucleic acid of the invention is target RNA or DNA.

By "complementarity" is meant that a nucleic acid can form hydrogen bond(s) with another nucleic acid sequence by either traditional Watson-Crick or other non-traditional types as described herein. In one embodiment, a double stranded nucleic acid molecule of the invention, such as an siNA molecule, wherein each strand is between 15 and 30 nucleotides in length, comprises between about 10% and about 100% (e.g., about 10%, 20%, 30%, 40%, 50%, 60%, 70%, 80%, 90%, or 100%) complementarity between the two strands of the double stranded nucleic acid molecule. In another embodiment, a double stranded nucleic acid molecule of the invention, such as an siNA molecule, where one strand is the sense strand and the other stand is the antisense strand, wherein each strand is between 15 and 30 nucleotides in length, comprises between at least about 10% and about 100% (e.g., at least about 10%, 20%, 30%, 40%, 50%, 60%, 70%, 80%, 90%, or 100%) complementarity between the nucleotide sequence in the antisense strand of the double stranded nucleic acid molecule and the nucleotide sequence of its corresponding target nucleic acid molecule, such as a target RNA or target mRNA or viral RNA. In one embodiment, a double stranded nucleic acid molecule of the invention, such as an siNA molecule, where one strand comprises nucleotide sequence that is referred to as the sense region and the other strand comprises a nucleotide sequence that is referred to as the antisense region, wherein each strand is between 15 and 30 nucleotides in length, comprises between about 10% and about 100% (e.g., about 10%, 20%, 30%, 40%, 50%, 60%, 70%, 80%, 90%, or 100%) complementarity between the sense region and the antisense region of the double stranded nucleic acid molecule. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol.* LII pp. 123-133; Frier et al., 1986, *Proc. Nat. Acad. Sci. USA* 83:9373-9377; Turner et al., 1987, *J. Am. Chem. Soc.* 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). In one embodiment, a siNA molecule of the invention has perfect complementarity between the sense strand or sense region and the antisense strand or antisense region of the siNA molecule. In one embodiment, a siNA molecule of the invention is perfectly complementary to a corresponding target nucleic acid molecule. "Perfectly complementary" means that all the contiguous residues of a nucleic acid sequence will hydrogen bond with the same number of contiguous residues in a second nucleic acid sequence. In one embodiment, a siNA molecule of the invention comprises about 15 to about 30 or more (e.g., about 15, 16, 17, 18, 19, 20, 21, 22, 23, 24, 25, 26, 27, 28, 29, or 30 or more) nucleotides that are complementary to one or more target nucleic acid molecules or a portion thereof. In one embodiment, a siNA molecule of the invention has partial complementarity (i.e., less than 100% complementarity) between the sense strand or sense region and the antisense strand or antisense region of the siNA molecule or between the antisense strand or antisense region of the siNA molecule and a corresponding target nucleic acid molecule. For example, partial complementarity can include various mismatches or non-based paired nucleotides (e.g., 1, 2, 3, 4, 5 or more mismatches or non-based paired nucleotides) within the siNA structure which can result in bulges, loops, or overhangs that result between the between the sense strand or sense region and the antisense strand or antisense region of the siNA molecule or between the antisense strand or antisense region of the siNA molecule and a corresponding target nucleic acid molecule.

In one embodiment, a double stranded nucleic acid molecule of the invention, such as siNA molecule, has perfect complementarity between the sense strand or sense region and the antisense strand or antisense region of the nucleic acid molecule. In one embodiment, double stranded nucleic acid molecule of the invention, such as siNA molecule, is perfectly complementary to a corresponding target nucleic acid molecule.

In one embodiment, double stranded nucleic acid molecule of the invention, such as siNA molecule, has partial complementarity (i.e., less than 100% complementarity) between the sense strand or sense region and the antisense strand or antisense region of the double stranded nucleic acid molecule or between the antisense strand or antisense region of the nucleic acid molecule and a corresponding target nucleic acid molecule. For example, partial complementarity can include various mismatches or non-base paired nucleotides (e.g., 1, 2, 3, 4, 5 or more mismatches or non-based paired nucleotides, such as nucleotide bulges) within the double stranded nucleic acid molecule, structure which can result in bulges, loops, or overhangs that result between the sense strand or sense region and the antisense strand or antisense region of the double stranded nucleic acid molecule or between the antisense strand or antisense region of the double stranded nucleic acid molecule and a corresponding target nucleic acid molecule.

In one embodiment, double stranded nucleic acid molecule of the invention is a microRNA (miRNA). By "mircoRNA" or "miRNA" is meant, a small double stranded RNA that regulates the expression of target messenger RNAs either by mRNA cleavage, translational repression/inhibition or heterochromatic silencing (see for example Ambros, 2004, Nature, 431, 350-355; Bartel, 2004, Cell, 116, 281-297; Cullen, 2004, Virus Research., 102, 3-9; He et al., 2004, Nat. Rev. Genet., 5, 522-531; and Ying et al., 2004, Gene, 342, 25-28). In one embodiment, the microRNA of the invention, has partial complementarity (i.e., less than 100% complementarity) between the sense strand or sense region and the antisense strand or antisense region of the miRNA molecule or between the antisense strand or antisense region of the miRNA and a corresponding target nucleic acid molecule. For example, partial complementarity can include various mismatches or non-base paired nucleotides (e.g., 1, 2, 3, 4, 5 or more mismatches or non-based paired nucleotides, such as nucleotide bulges) within the double stranded nucleic acid molecule, structure which can result in bulges, loops, or overhangs that result between the sense strand or sense region and the antisense strand or antisense region of the miRNA or between the antisense strand or antisense region of the miRNA and a corresponding target nucleic acid molecule.

In one embodiment, siNA molecules of the invention that down regulate or reduce target gene expression are used for preventing or treating diseases, disorders, conditions, or traits in a subject or organism as described herein or otherwise known in the art.

In one embodiment siNA molecules of the invention that down regulate or reduce VEGF and/or VEGFR gene expression are used for treating, preventing or reducing ocular disease, cancer, proliferative disease, inflammatory disease, respiratory disease, neurologic disease, allergic disease, renal disease, or angiogenesis in a subject or organism.

By "proliferative disease" or "cancer" as used herein is meant, any disease, condition, trait, genotype or phenotype characterized by unregulated cell growth or replication as is known in the art; including leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and any other cancer or proliferative disease, condition, trait, genotype or phenotype that can respond to the modulation of disease related gene expression in a cell or tissue, alone or in combination with other therapies.

By "inflammatory disease" or "inflammatory condition" as used herein is meant any disease, condition, trait, genotype or phenotype characterized by an inflammatory or allergic process as is known in the art, such as inflammation, acute inflammation, chronic inflammation, respiratory disease, atherosclerosis, psoriasis, dermatitis, restenosis, asthma, allergic rhinitis, atopic dermatitis, septic shock, rheumatoid arthritis, inflammatory bowl disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses, and any other inflammatory disease, condition, trait, genotype or phenotype that can respond to the modulation of disease related gene expression in a cell or tissue, alone or in combination with other therapies.

By "autoimmune disease" or "autoimmune condition" as used herein is meant, any disease, condition, trait, genotype or phenotype characterized by autoimmunity as is known in the art, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and any other autoimmune disease, condition, trait, genotype or phenotype that can respond to the modulation of disease related gene expression in a cell or tissue, alone or in combination with other therapies.

By "neurologic disease" or "neurological disease" is meant any disease, disorder, or condition affecting the central or peripheral nervous system, including ADHD, AIDS-Neurological Complications, Absence of the Septum Pellucidum, Acquired Epileptiform Aphasia, Acute Disseminated Encephalomyelitis, Adrenoleukodystrophy, Agenesis of the Corpus Callosum, Agnosia, Aicardi Syndrome, Alexander Disease, Alpers' Disease, Alternating Hemiplegia, Alzheimer's Disease, Amyotrophic Lateral Sclerosis, Anencephaly, Aneurysm, Angelman Syndrome, Angiomatosis, Anoxia, Aphasia, Apraxia, Arachnoid Cysts, Arachnoiditis, Arnold-Chiari Malformation, Arteriovenous Malformation, Aspartame, Asperger Syndrome, Ataxia Telangiectasia, Ataxia, Attention Deficit-Hyperactivity Disorder, Autism, Autonomic Dysfunction, Back Pain, Barth Syndrome, Batten Disease, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain Aneurysm, Brain Injury, Brain and Spinal Tumors, Brown-Sequard Syndrome, Bulbospinal Muscular Atrophy, Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Cephalic Disorders, Cerebellar Degeneration, Cerebellar Hypoplasia, Cerebral Aneurysm, Cerebral Arteriosclerosis, Cerebral Atrophy, Cerebral Beriberi, Cerebral Gigantism, Cerebral Hypoxia, Cerebral Palsy, Cerebro-Oculo-Facio-Skeletal Syndrome, Charcot-Marie-Tooth Disorder, Chiari Malformation, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Coma, including Persistent Vegetative State, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Creutzfeldt-Jakob Disease, Cumulative Trauma Disorders, Cushing's Syndrome, Cytomegalic Inclusion Body Disease (CIBD), Cytomegalovirus Infection, Dancing Eyes-Dancing Feet Syndrome, Dandy-Walker Syndrome, Dawson Disease, De Morsier's Syndrome, Dejerine-Klumpke Palsy, Dementia-Multi-Infarct, Dementia-Subcortical, Dementia With Lewy Bodies, Dermatomyositis, Developmental Dyspraxia, Devic's Syndrome, Diabetic Neuropathy, Diffuse Sclerosis, Dravet's Syndrome, Dysautonomia, Dysgraphia, Dyslexia, Dysphagia, Dyspraxia, Dystonias, Early Infantile Epileptic Encephalopathy, Empty Sella Syndrome, Encephalitis Lethargica, Encephalitis and Meningitis, Encephaloceles, Encephalopathy, Encephalotrigeminal Angiomatosis, Epilepsy, Erb's Palsy, Erb-Duchenne and Dejerine-Klumpke Palsies, Fabry's Disease, Fahr's Syndrome, Fainting, Familial Dysautonomia, Familial Hemangioma, Familial Idiopathic Basal Ganglia Calcification, Familial Spastic Paralysis, Febrile Seizures (e.g., GEFS and GEFS plus), Fisher Syndrome, Floppy Infant Syndrome, Friedreich's Ataxia, Gaucher's Disease, Gerstmann's Syndrome, Gerstmann-Straussler-Scheinker Disease, Giant Cell Arteritis, Giant Cell Inclusion Disease, Globoid Cell Leukodystrophy, Glossopharyngeal Neuralgia, Guillain-Barre Syndrome, HTLV-1 Associated Myelopathy, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster Oticus, Herpes Zoster, Hirayama Syndrome, Holoprosencephaly, Huntington's Disease, Hydranencephaly, Hydrocephalus-Normal Pressure, Hydrocephalus, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Phytanic Acid Storage Disease, Infantile Refsum Disease, Infantile Spasms, Inflammatory Myopathy, Intestinal Lipodystrophy, Intracranial Cysts, Intracranial Hypertension, Isaac's Syndrome, Joubert Syndrome, Kearns-Sayre Syndrome, Kennedy's Disease, Kinsbourne syndrome, Kleine-Levin syndrome, Klippel Feil Syndrome, Klippel-Trenaunay Syndrome (KTS), Klüver-Bucy Syndrome, Korsakoffs Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lissencephaly, Locked-In Syndrome, Lou Gehrig's Disease, Lupus-Neurological Sequelae, Lyme Disease-Neurological Complications, Machado-Joseph Disease, Macrencephaly, Megalencephaly, Melkersson-Rosenthal Syndrome, Meningitis, Menkes Disease, Meralgia Paresthetica, Metachromatic Leukodystrophy, Microcephaly, Migraine, Miller Fisher Syndrome, Mini-Strokes, Mitochondrial Myopathies, Mobius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy with Orthostatic Hypotension, Multiple System Atrophy, Muscular Dystrophy, Myasthenia-Congenital, Myasthenia Gravis, Myelinoclastic Diffuse Sclerosis, Myoclonic Encephalopathy of Infants, Myoclonus, Myopathy-Congenital, Myopathy-Thyrotoxic, Myopathy, Myotonia Congenita, Myotonia, Narcolepsy, Neuroacanthocytosis, Neurodegeneration with Brain Iron Accumulation, Neurofibromatosis, Neuroleptic Malignant Syndrome, Neurological Complications of AIDS, Neurological Manifestations of Pompe Disease, Neuromyelitis Optica, Neuromyotonia, Neuronal Ceroid Lipofuscinosis, Neuronal Migration Disorders, Neuropathy-Hereditary, Neurosarcoidosis, Neurotoxicity, Nevus Cavernosus, Niemann-Pick Disease, O'Sullivan-McLeod Syndrome, Occipital Neuralgia, Occult Spinal Dysraphism Sequence, Ohtahara Syndrome, Olivopontocerebellar Atrophy, Opsoclonus Myoclonus, Orthostatic Hypotension, Overuse Syndrome, Pain-Chronic, Paraneoplastic Syndromes, Paresthesia, Parkinson's Disease, Parmyotonia Congenita, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Lateral Sclerosis, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Pseudotumor Cerebri, Pyridoxine Dependent and Pyridoxine Responsive Siezure Disorders, Ramsay Hunt Syndrome Type I, Ramsay Hunt Syndrome Type II, Rasmussen's Encephalitis and other autoimmune epilepsies, Reflex Sympathetic Dystrophy Syndrome, Refsum Disease-Infantile, Refsum Disease, Repetitive Motion Disorders, Repetitive Stress Injuries, Restless Legs Syndrome, Retrovirus-Associated Myelopathy, Rett Syndrome, Reye's Syndrome, Riley-Day Syndrome, SUNCT Headache, Sacral Nerve Root Cysts, Saint Vitus Dance, Salivary Gland Disease, Sandhoff Disease, Schilder's Disease, Schizencephaly, Seizure Disorders, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Soto's Syndrome, Spasticity, Spina Bifida, Spinal Cord Infarction, Spinal Cord Injury, Spinal Cord Tumors, Spinal Muscular Atrophy, Spinocerebellar Atrophy, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen Disease, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Tuberous Sclerosis, Vascular Erectile Tumor, Vasculitis including Temporal Arteritis, Von Economo's Disease, Von Hippel-Lindau disease (VHL), Von Recklinghausen's Disease, Wallenberg's Syndrome, Werdnig-Hoffnan Disease, Wernicke-Korsakoff Syndrome, West Syndrome, Whipple's Disease, Williams Syndrome, Wilson's Disease, X-Linked Spinal and Bulbar Muscular Atrophy, and Zellweger Syndrome.

By "respiratory disease" is meant, any disease or condition affecting the respiratory tract, such as asthma, chronic obstructive pulmonary disease or "COPD", allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, and any other respiratory disease, condition, trait, genotype or phenotype that can respond to the modulation of disease related gene expression in a cell or tissue, alone or in combination with other therapies.

By "cardiovascular disease" is meant and disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischaemic attacks (TIA), angina (stable and unstable), atrial fibrillation, arrhythmia, vavular disease, congestive heart failure, hypercholoesterolemia, type I hyperlipoproteinemia, type II hyperlipoproteinemia, type III hyperlipoproteinemia, type IV hyperlipoproteinemia, type V hyperlipoproteinemia, secondary hypertrigliceridemia, and familial lecithin cholesterol acyltransferase deficiency.

By "ocular disease" as used herein is meant, any disease, condition, trait, genotype or phenotype of the eye and related structures as is known in the art, such as Cystoid Macular Edema, Asteroid Hyalosis, Pathological Myopia and Posterior Staphyloma, Toxocariasis (Ocular Larva Migrans), Retinal Vein Occlusion, Posterior Vitreous Detachment, Tractional Retinal Tears, Epiretinal Membrane, Diabetic Retinopathy, Lattice Degeneration, Retinal Vein Occlusion, Retinal Artery Occlusion, Macular Degeneration (e.g., age related macular degeneration such as wet AMD or dry AMD), Toxoplasmosis, Choroidal Melanoma, Acquired Retinoschisis, Hollenhorst Plaque, Idiopathic Central Serous Chorioretinopathy, Macular Hole, Presumed Ocular Histoplasmosis Syndrome, Retinal Macroaneursym, Retinitis Pigmentosa, Retinal Detachment, Hypertensive Retinopathy, Retinal Pigment Epithelium (RPE) Detachment, Papillophlebitis, Ocular Ischemic Syndrome, Coats' Disease, Leber's Miliary Aneurysm, Conjunctival Neoplasms, Allergic Conjunctivitis, Vernal Conjunctivitis, Acute Bacterial Conjunctivitis, Allergic Conjunctivitis & Vernal Keratoconjunctivitis, Viral Conjunctivitis, Bacterial Conjunctivitis, Chlamydial & Gonococcal Conjunctivitis, Conjunctival Laceration, Episcleritis, Scleritis, Pingueculitis, Pterygium, Superior Limbic Keratoconjunctivitis (SLK of Theodore), Toxic Conjunctivitis, Conjunctivitis with Pseudomembrane, Giant Papillary Conjunctivitis, Terrien's Marginal Degeneration, Acanthamoeba Keratitis, Fungal Keratitis, Filamentary Keratitis, Bacterial Keratitis, Keratitis Sicca/Dry Eye Syndrome, Bacterial Keratitis, Herpes Simplex Keratitis, Sterile Corneal Infiltrates, Phlyctenulosis, Corneal Abrasion & Recurrent Corneal Erosion, Corneal Foreign Body, Chemical Burs, Epithelial Basement Membrane Dystrophy (EBMD), Thygeson's Superficial Punctate Keratopathy, Corneal Laceration, Salzmann's Nodular Degeneration, Fuchs' Endothelial Dystrophy, Crystalline Lens Subluxation, Ciliary-Block Glaucoma, Primary Open-Angle Glaucoma, Pigment Dispersion Syndrome and Pigmentary Glaucoma, Pseudoexfoliation Syndrom and Pseudoexfoliative Glaucoma, Anterior Uveitis, Primary Open Angle Glaucoma, Uveitic Glaucoma & Glaucomatocyclitic Crisis, Pigment Dispersion Syndrome & Pigmentary Glaucoma, Acute Angle Closure Glaucoma, Anterior Uveitis, Hyphema, Angle Recession Glaucoma, Lens Induced Glaucoma, Pseudoexfoliation Syndrome and Pseudoexfoliative Glaucoma, Axenfeld-Rieger Syndrome, Neovascular Glaucoma, Pars Planitis, Choroidal Rupture, Duane's Retraction Syndrome, Toxic/Nutritional Optic Neuropathy, Aberrant Regeneration of Cranial Nerve III, Intracranial Mass Lesions, Carotid-Cavernous Sinus Fistula, Anterior Ischemic Optic Neuropathy, Optic Disc Edema & Papilledema, Cranial Nerve III Palsy, Cranial Nerve IV Palsy, Cranial Nerve VI Palsy, Cranial Nerve VII (Facial Nerve) Palsy, Horner's Syndrome, Internuclear Ophthalmoplegia, Optic Nerve Head Hypoplasia, Optic Pit, Tonic Pupil, Optic Nerve Head Drusen, Demyelinating Optic Neuropathy (Optic Neuritis, Retrobulbar Optic Neuritis), Amaurosis Fugax and Transient Ischemic Attack, Pseudotumor Cerebri, Pituitary Adenoma, Molluscum Contagiosum, Canaliculitis, Verruca and Papilloma, Pediculosis and Pthiriasis, Blepharitis, Hordeolum, Preseptal Cellulitis, Chalazion, Basal Cell Carcinoma, Herpes Zoster Ophthalmicus, Pediculosis & Phthiriasis, Blow-out Fracture, Chronic Epiphora, Dacryocystitis, Herpes Simplex Blepharitis, Orbital Cellulitis, Senile Entropion, and Squamous Cell Carcinoma.

By "metabolic disease" is meant any disease or condition affecting metabolic pathways as in known in the art. Metabolic disease can result in an abnormal metabolic process, either congenital due to inherited enzyme abnormality (inborn errors of metabolism) or acquired due to disease of an endocrine organ or failure of a metabolically important organ such as the liver. In one embodiment, metabolic disease includes obesity, insulin resistance, and diabetes (e.g., type I and/or type II diabetes).

By "dermatological disease" is meany any disease or condition of the skin, dermis, or any substructure therein such as hair, follicle, etc. Dermatological diseases, disorders, conditions, and traits can include rosacea, psoriasis, ectopic dermatitis, skin cancers such as melanoma and basal cell carcinoma, hair loss, hair removal, alterations in pigmentation, and any other disease, condition, or trait associated with the skin, dermis, or structures therein.

By "auditory disease" is meany any disease or condition of the auditory system, including the ear, such as the inner ear, middle ear, outer ear, auditory nerve, and any substructures therein. Auditory diseases, disorders, conditions, and traits can include hearing loss, deafness, tinnitus, Meniere's Disease, vertigo, balance and motion disorders, and any other disease, condition, or trait associated with the ear, or structures therein.

In one embodiment of the present invention, each sequence of a siNA molecule of the invention is independently about 15 to about 30 nucleotides in length, in specific embodiments about 15, 16, 17, 18, 19, 20, 21, 22, 23, 24, 25, 26, 27, 28, 29, or 30 nucleotides in length. In another embodiment, the siNA duplexes of the invention independently comprise about 15 to about 30 base pairs (e.g., about 15, 16, 17, 18, 19, 20, 21, 22, 23, 24, 25, 26, 27, 28, 29, or 30). In another embodiment, one or more strands of the siNA molecule of the invention independently comprises about 15 to about 30 nucleotides (e.g., about 15, 16, 17, 18, 19, 20, 21, 22, 23, 24, 25, 26, 27, 28, 29, or 30) that are complementary to a target nucleic acid molecule. In yet another embodiment, siNA molecules of the invention comprising hairpin or circular structures are about 35 to about 55 (e.g., about 35, 40, 45, 50 or 55) nucleotides in length, or about 38 to about 44 (e.g., about 38, 39, 40, 41, 42, 43, or 44) nucleotides in length and comprising about 15 to about 25 (e.g., about 15, 16, 17, 18, 19, 20, 21, 22, 23, 24, or 25) base pairs. Exemplary siNA molecules of the invention are shown in Table II and/or FIGS. 4-5.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The siNA molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through local delivery to the lung, with or without their incorporation in biopolymers. In particular embodiments, the nucleic acid molecules of the invention comprise sequences shown in Tables II-III and/or FIGS. 4-5. Examples of such nucleic acid molecules consist essentially of sequences defined in these tables and figures. Furthermore, the chemically modified constructs described in Table I can be applied to any siNA sequence of the invention.

In another aspect, the invention provides mammalian cells containing one or more siNA molecules of this invention. The one or more siNA molecules can independently be targeted to the same or different sites.

By "RNA" is meant a molecule comprising at least one ribonucleotide residue. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the nucleic acid molecules of the invention can be administered. A subject can be a mammal or mammalian cells, including a human or human cells.

By "chemical modification" as used herein is meant any modification of chemical structure of the nucleotides that differs from nucleotides of native siRNA or RNA. The term "chemical modification" encompasses the addition, substitution, or modification of native siRNA or RNA nucleosides and nucleotides with modified nucleosides and modified nucleotides as described herein or as is otherwise known in the art. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides (see for example U.S. Ser. No. 10/981,966 filed Nov. 5, 2004, incorporated by reference herein), "universal base" nucleotides, "acyclic" nucleotides, 5-C-methyl nucleotides, terminal glyceryl and/or inverted deoxy abasic residue incorporation, or a modification having any of Formulae I-VII herein.

The term "phosphorothioate" as used herein refers to an internucleotide linkage having Formula I, wherein Z and/or W comprise a sulfur atom. Hence, the term phosphorothioate refers to both phosphorothioate and phosphorodithioate internucleotide linkages.

The term "phosphonoacetate" as used herein refers to an internucleotide linkage having Formula I, wherein Z and/or W comprise an acetyl or protected acetyl group.

The term "thiophosphonoacetate" as used herein refers to an internucleotide linkage having Formula I, wherein Z comprises an acetyl or protected acetyl group and W comprises a sulfur atom or alternately W comprises an acetyl or protected acetyl group and Z comprises a sulfur atom.

The term "universal base" as used herein refers to nucleotide base analogs that form base pairs with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example Loakes, 2001, *Nucleic Acids Research*, 29, 2437-2447).

The term "acyclic nucleotide" as used herein refers to any nucleotide having an acyclic ribose sugar, for example where any of the ribose carbons (C1, C2, C3, C4, or C5), are independently or in combination absent from the nucleotide.

The nucleic acid molecules of the instant invention, individually, or in combination or in conjunction with other drugs, can be used to treat, inhibit, reduce, or prevent ocular disease, cancer, proliferative disease, inflammatory disease, respiratory disease, neurologic disease, allergic disease, renal disease, or angiogenesis in a subject or organism. For example, the siNA molecules can be administered to a subject or can be administered to other appropriate cells evident to those skilled in the art, individually or in combination with one or more drugs under conditions suitable for the treatment.

In one embodiment, the siNA molecules of the invention can be administered to a subject or can be administered to other appropriate cells evident to those skilled in the art, individually or in combination with one or more drugs under conditions suitable for the treatment.

In a further embodiment, the siNA molecules can be used in combination with other known treatments to treat, inhibit, reduce, or prevent ocular disease, cancer, proliferative disease, inflammatory disease, respiratory disease, neurologic disease, allergic disease, renal disease, or angiogenesis in a subject or organism. For example, the described molecules could be used in combination with one or more known compounds, treatments, or procedures to treat, inhibit, reduce, or prevent ocular disease, cancer, proliferative disease, inflammatory disease, respiratory disease, neurologic disease, allergic disease, renal disease, or angiogenesis in a subject or organism as are known in the art.

In one embodiment, the invention features an expression vector comprising a nucleic acid sequence encoding at least one siNA molecule of the invention, in a manner which allows expression of the siNA molecule. For example, the vector can contain sequence(s) encoding both strands of a siNA molecule comprising a duplex. The vector can also contain sequence(s) encoding a single nucleic acid molecule that is self-complementary and thus forms a siNA molecule. Non-limiting examples of such expression vectors are described in Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, *Nature Medicine*, advance online publication doi:10.1038/nm725.

In another embodiment, the invention features a mammalian cell, for example, a human cell, including an expression vector of the invention.

In yet another embodiment, the expression vector of the invention comprises a sequence for a siNA molecule having complementarity to a RNA molecule referred to by a Genbank Accession numbers, for example Genbank Accession Nos. shown in U.S. Ser. Nos. 10/923,536 and 10/923,536, both incorporated by reference herein.

In one embodiment, an expression vector of the invention comprises a nucleic acid sequence encoding two or more siNA molecules, which can be the same or different.

In another aspect of the invention, siNA molecules that interact with VEGF and/or VEGFR target RNA molecules and down-regulate gene encoding VEGF and/or VEGFR target RNA molecules (for example VEGF and/or VEGFR target RNA molecules referred to by Genbank Accession numbers herein) are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in VEGF and/or VEGFR target cells. Alternatively, viral vectors can be used that provide for transient expression of siNA molecules. Such vectors can be repeatedly administered as necessary. Once expressed, the siNA molecules bind and down-regulate gene function or expression via RNA interference (RNAi). Delivery of siNA expressing vectors can be systemic, such as by intravenous or intramuscular administration, by administration to target cells ex-planted from a subject followed by reintroduction into the subject, or by any other means that would allow for introduction into the desired VEGF and/or VEGFR target cell.

By "vectors" is meant any nucleic acid- and/or viral-based technique used to deliver a desired nucleic acid.

Other features and advantages of the invention will be apparent from the following description of the preferred embodiments thereof, and from the claims.

BRIEF DESCRIPTION OF THE DRAWINGS

FIG. 1 shows a non-limiting example of a scheme for the synthesis of siNA molecules. The complementary siNA sequence strands, strand 1 and strand 2, are synthesized in tandem and are connected by a cleavable linkage, such as a nucleotide succinate or abasic succinate, which can be the same or different from the cleavable linker used for solid phase synthesis on a solid support. The synthesis can be either solid phase or solution phase, in the example shown, the synthesis is a solid phase synthesis. The synthesis is performed such that a protecting group, such as a dimethoxytrityl group, remains intact on the terminal nucleotide of the tandem oligonucleotide. Upon cleavage and deprotection of the oligonucleotide, the two siNA strands spontaneously hybridize to form a siNA duplex, which allows the purification of the duplex by utilizing the properties of the terminal protecting group, for example by applying a trityl on purification method wherein only duplexes/oligonucleotides with the terminal protecting group are isolated.

FIG. 4A: The sense strand comprises 21 nucleotides wherein the two terminal 3'-nucleotides are optionally base paired and wherein all nucleotides present are ribonucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety wherein the two terminal 3'-nucleotides are optionally complementary to the target RNA sequence, and wherein all nucleotides present are ribonucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4B: The sense strand comprises 21 nucleotides wherein the two terminal 3'-nucleotides are optionally base paired and wherein all pyrimidine nucleotides that may be present are 2'deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the sense and antisense strand.

FIG. 4C: The sense strand comprises 21 nucleotides having 5'- and 3'-terminal cap moieties wherein the two terminal 3'-nucleotides are optionally base paired and wherein all pyrimidine nucleotides that may be present are 2'-O-methyl or 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4D: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4E: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4F: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, and having one 3'-terminal phosphorothioate internucleotide linkage and wherein all pyrimidine nucleotides that may be present are 2'-deoxy-2'-fluoro modified nucleotides and all purine nucleotides that may be present are 2'-deoxy nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand. The antisense strand of constructs A-F comprise sequence complementary to any target nucleic acid sequence of the invention. Furthermore, when a glyceryl moiety (L) is present at the 3'-end of the antisense strand for any construct shown in FIG. 4 A-F, the modified internucleotide linkage is optional.

FIG. 6A-C shows non-limiting examples of different siNA constructs of the invention.

Figure 6A:
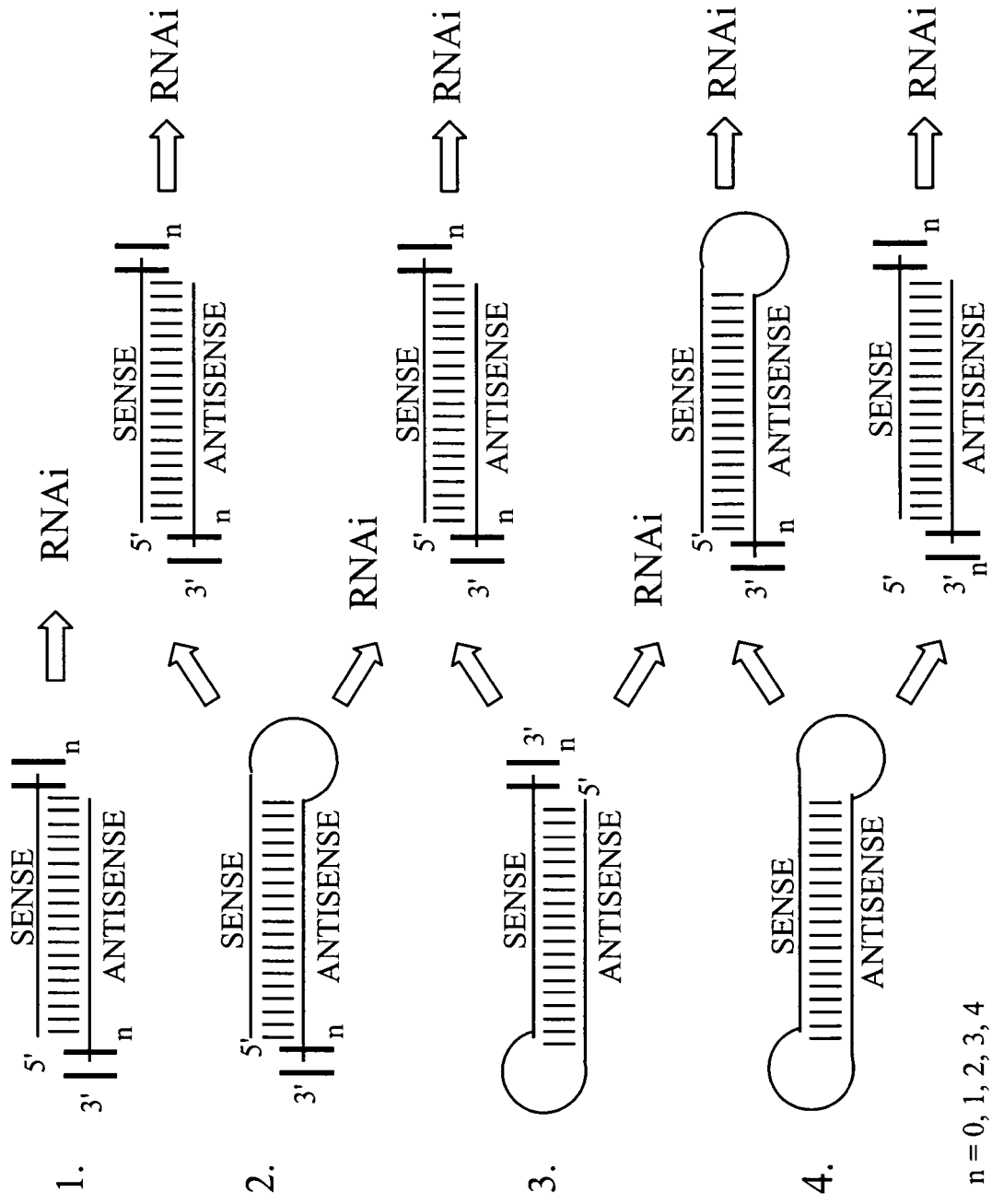

The examples shown in FIG. 6A (constructs 1, 2, and 3) have 19 representative base pairs; however, different embodiments of the invention include any number of base pairs described herein. Bracketed regions represent nucleotide overhangs, for example, comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

Figure 6B:
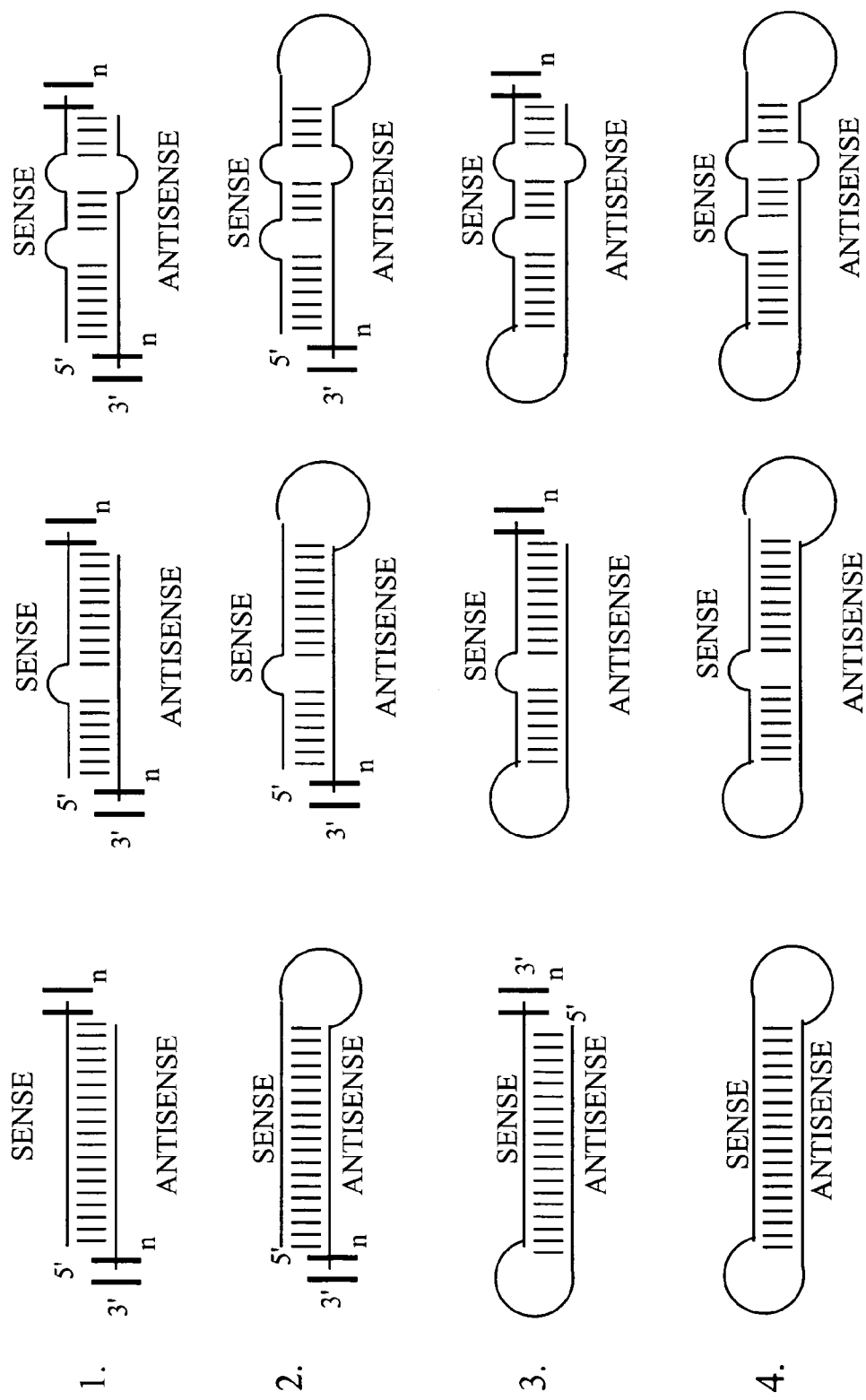

The examples shown in FIG. 6B represent different variations of double stranded nucleic acid molecule of the invention, such as microRNA, that can include overhangs, bulges, loops, and stem-loops resulting from partial complementarity. Such motifs having bulges, loops, and stem-loops are generally characteristics of miRNA. The bulges, loops, and stem-loops can result from any degree of partial complementarity, such as mismatches or bulges of about 1, 2, 3, 4, 5, 6, 7, 8, 9, 10 or more nucleotides in one or both strands of the double stranded nucleic acid molecule of the invention.

The example shown in FIG. 6C represents a model double stranded nucleic acid molecule of the invention comprising a 19 base pair duplex of two 21 nucleotide sequences having dinucleotide 3'-overhangs. The top strand (1) represents the sense strand (passenger strand), the middle strand (2) represents the antisense (guide strand), and the lower strand (3) represents a target polynucleotide sequence. The dinucleotide overhangs (NN) can comprise sequence derived from the target polynucleotide. For example, the 3'-(NN) sequence in the guide strand can be complementary to the 5'-[NN] sequence of the target polynucleotide. In addition, the 5'-(NN) sequence of the passenger strand can comprise the same sequence as the 5'-[NN] sequence of the target polynucleotide sequence. In other embodiments, the overhangs (NN) are not derived from the target polynucleotide sequence, for example where the 3'-(NN) sequence in the guide strand are not complementary to the 5'-[NN] sequence of the target polynucleotide and the 5'-(NN) sequence of the passenger strand can comprise different sequence from the 5'-[NN] sequence of the target polynucleotide sequence. In additional embodiments, any (NN) nucleotides are chemically modified, e.g., as 2'-O-methyl, 2'-deoxy-2'-fluoro, and/or other modifications herein. Furthermore, the passenger strand can comprise a ribonucleotide position N of the passenger strand. For the representative 19 base pair 21 mer duplex shown, position N can be 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow. In additional embodiments, there are two ribonucleotides, NN, at positions 10 and 11 based on the 5'-end of the guide strand by counting 10 and 11 nucleotide positions in from the 5'-terminus of the guide strand and picking the corresponding base paired nucleotides in the passenger strand.

Figure 7:
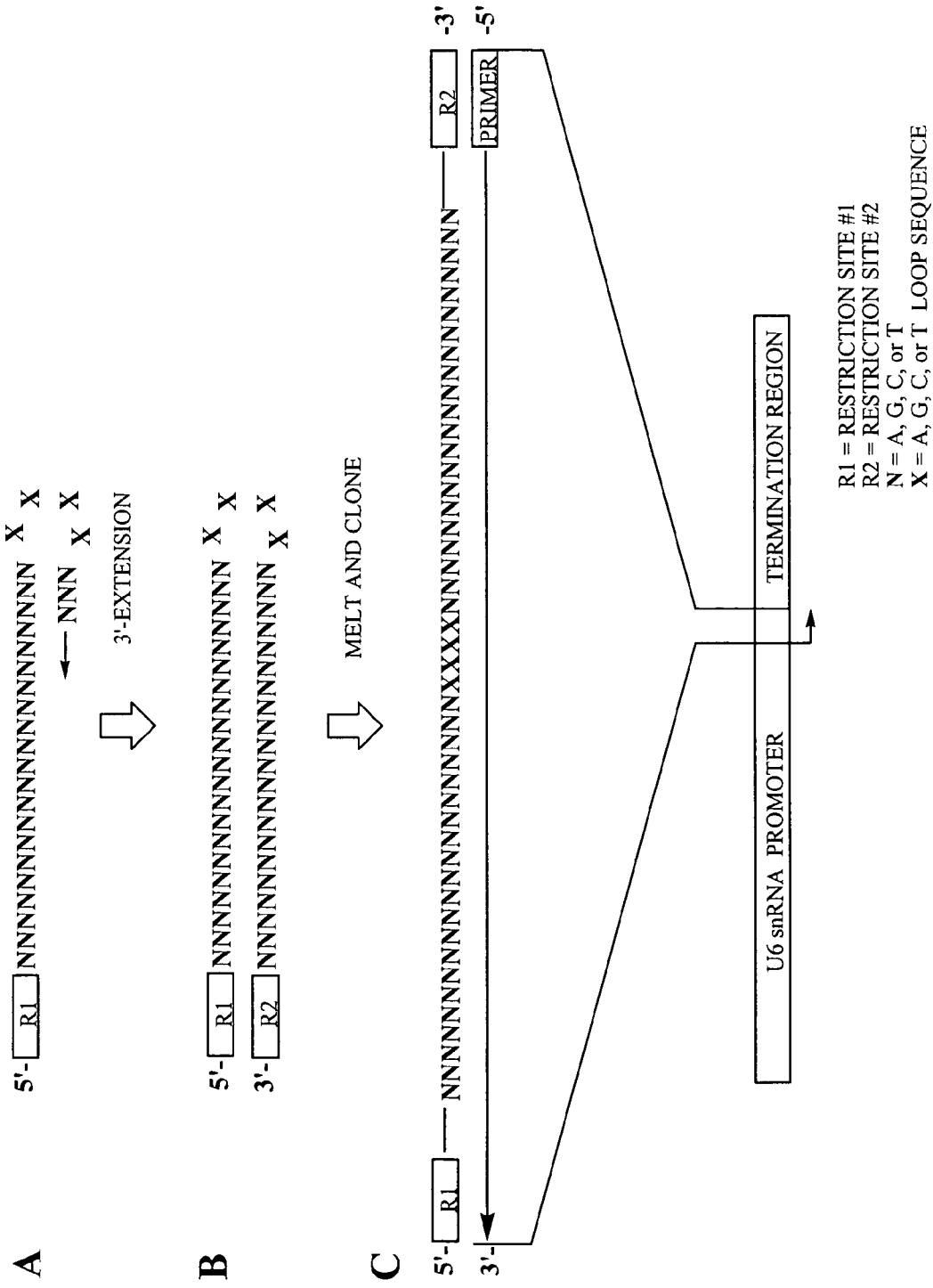

FIG. 7A-C is a diagrammatic representation of a scheme utilized in generating an expression cassette to generate siNA hairpin constructs.

FIG. 7A: A DNA oligomer is synthesized with a 5'-restriction site (R1) sequence followed by a region having sequence identical (sense region of siNA) to a predetermined target sequence, wherein the sense region comprises, for example, about 19, 20, 21, or 22 nucleotides (N) in length, which is followed by a loop sequence of defined sequence (X), comprising, for example, about 3 to about 10 nucleotides.

FIG. 7B: The synthetic construct is then extended by DNA polymerase to generate a hairpin structure having self-complementary sequence that will result in a siNA transcript having specificity for a target sequence and having self-complementary sense and antisense regions.

FIG. 7C: The construct is heated (for example to about 95° C.) to linearize the sequence, thus allowing extension of a complementary second DNA strand using a primer to the 3'-restriction sequence of the first strand. The double-stranded DNA is then inserted into an appropriate vector for expression in cells. The construct can be designed such that a 3'-terminal nucleotide overhang results from the transcription, for example, by engineering restriction sites and/or utilizing a poly-U termination region as described in Paul et al., 2002, *Nature Biotechnology*, 29, 505-508.

Figure 8:
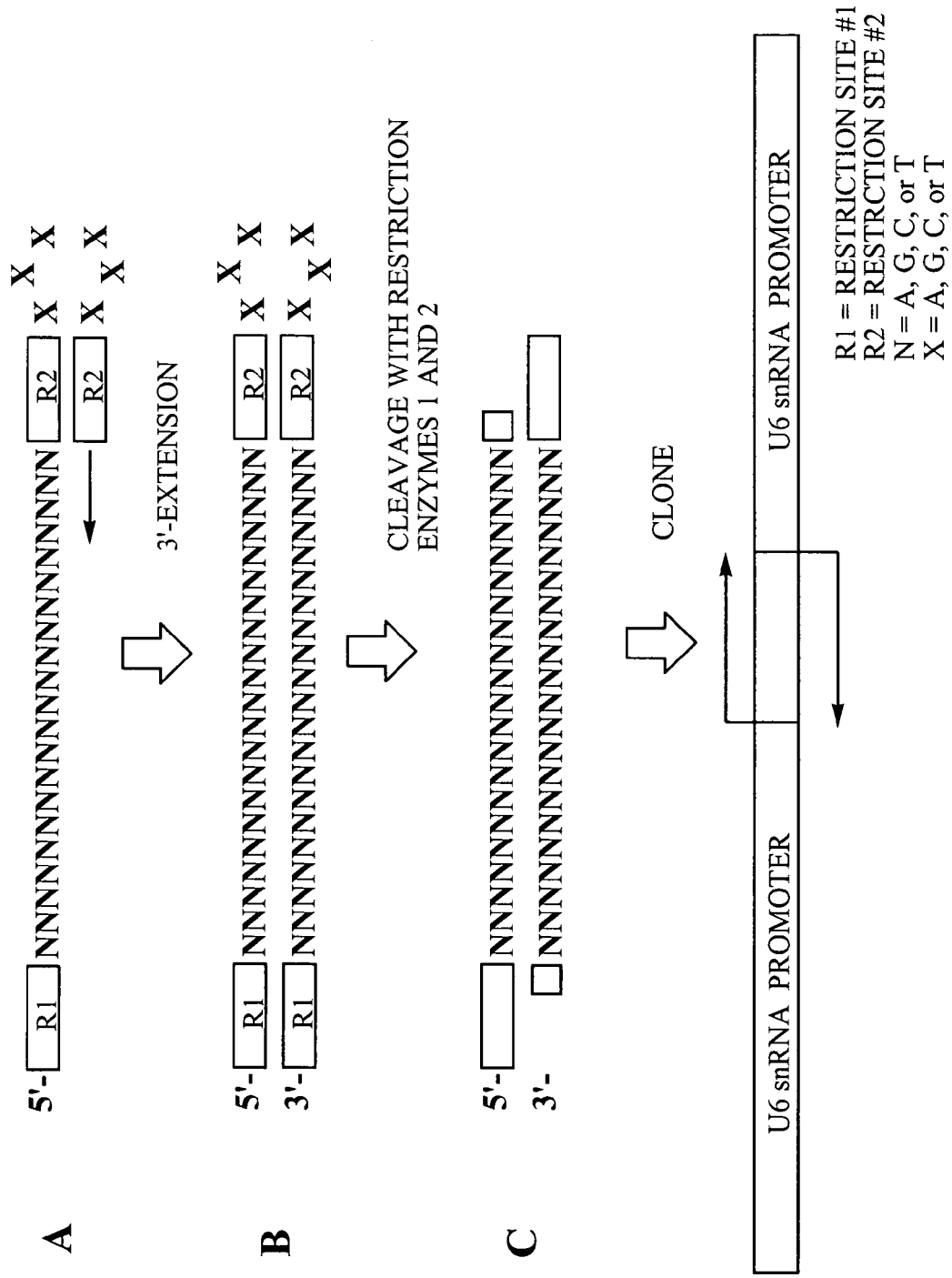

FIG. 8A-C is a diagrammatic representation of a scheme utilized in generating an expression cassette to generate double-stranded siNA constructs.

FIG. 8A: A DNA oligomer is synthesized with a 5'-restriction (R1) site sequence followed by a region having sequence identical (sense region of siNA) to a predetermined target sequence, wherein the sense region comprises, for example, about 19, 20, 21, or 22 nucleotides (N) in length, and which is followed by a 3'-restriction site (R2) which is adjacent to a loop sequence of defined sequence (X).

FIG. 8B: The synthetic construct is then extended by DNA polymerase to generate a hairpin structure having self-complementary sequence.

FIG. 8C: The construct is processed by restriction enzymes specific to R1 and R2 to generate a double-stranded DNA which is then inserted into an appropriate vector for expression in cells. The transcription cassette is designed such that a U6 promoter region flanks each side of the dsDNA which generates the separate sense and antisense strands of the siNA. Poly T termination sequences can be added to the constructs to generate U overhangs in the resulting transcript.

FIG. 9A-E is a diagrammatic representation of a method used to determine target sites for siNA mediated RNAi within a particular target nucleic acid sequence, such as messenger RNA.

FIG. 9A: A pool of siNA oligonucleotides are synthesized wherein the antisense region of the siNA constructs has complementarity to target sites across the target nucleic acid sequence, and wherein the sense region comprises sequence complementary to the antisense region of the siNA.

FIGS. 9B&C: (FIG. 9B) The sequences are pooled and are inserted into vectors such that (FIG. 9C) transfection of a vector into cells results in the expression of the siNA.

FIG. 9D: Cells are sorted based on phenotypic change that is associated with modulation of the target nucleic acid sequence.

FIG. 9E: The siNA is isolated from the sorted cells and is sequenced to identify efficacious target sites within the target nucleic acid sequence.

Figure 10:
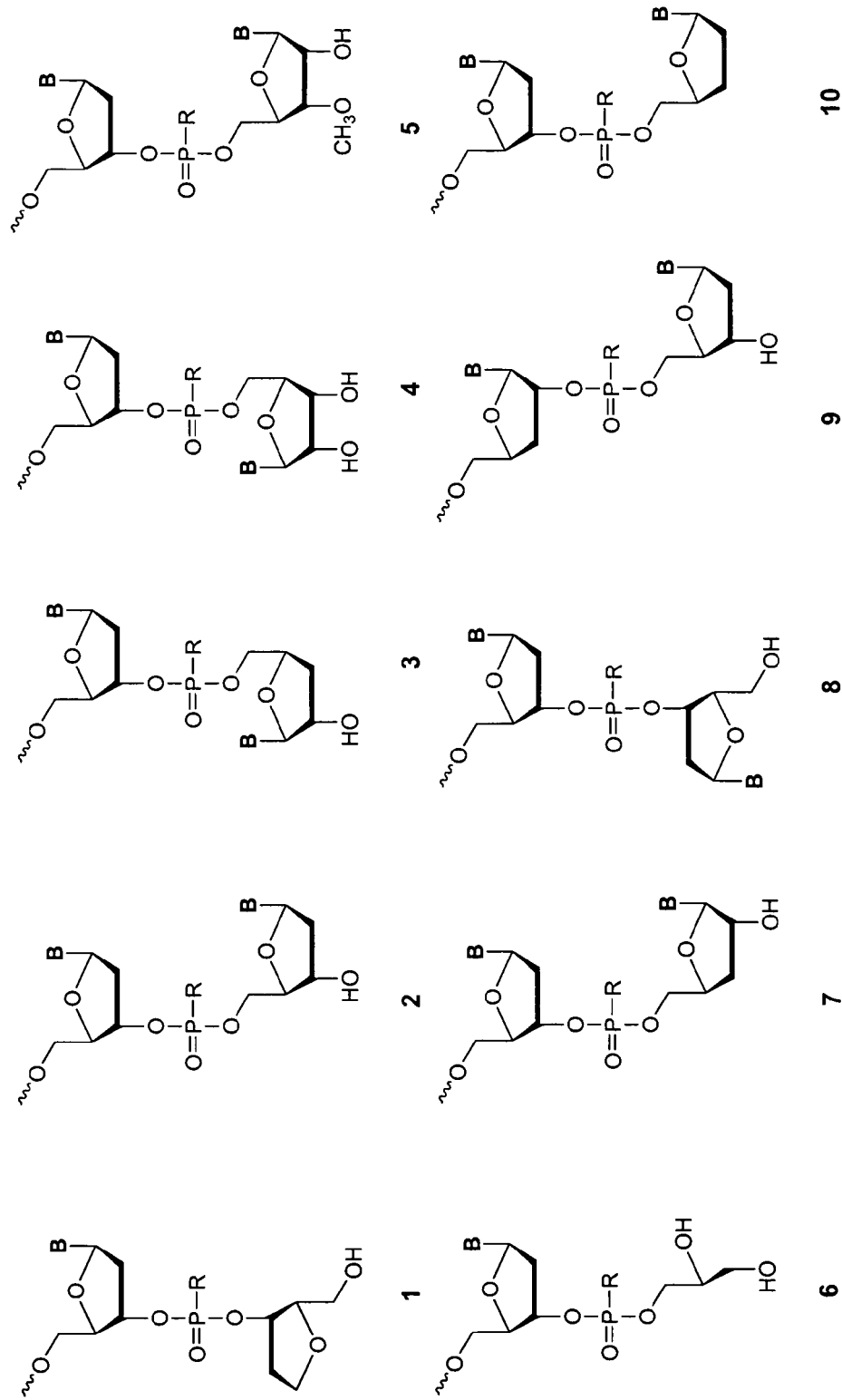

FIG. 10 shows non-limiting examples of different stabilization chemistries (1-10) that can be used, for example, to stabilize the 3'-end of siNA sequences of the invention, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']deoxyribonucleotide; and (10) [5-3']-dideoxyribonucleotide. In addition to modified and unmodified backbone chemistries indicated in the figure, these chemistries can be combined with different backbone modifications as described herein, for example, backbone modifications having Formula I. In addition, the 2'-deoxy nucleotide shown 5' to the terminal modifications shown can be another modified or unmodified nucleotide or non-nucleotide described herein, for example modifications having any of Formulae I-VII or any combination thereof.

FIG. 11 shows a non-limiting example of a strategy used to identify chemically modified siNA constructs of the invention that are nuclease resistance while preserving the ability to mediate RNAi activity. Chemical modifications are introduced into the siNA construct based on educated design parameters (e.g. introducing 2'-mofications, base modifications, backbone modifications, terminal cap modifications etc). The modified construct in tested in an appropriate system (e.g. human serum for nuclease resistance, shown, or an animal model for PK/delivery parameters). In parallel, the siNA construct is tested for RNAi activity, for example in a cell culture system such as a luciferase reporter assay). Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

FIG. 12 shows non-limiting examples of phosphorylated siNA molecules of the invention, including linear and duplex constructs and asymmetric derivatives thereof.

FIG. 13 shows non-limiting examples of chemically modified terminal phosphate groups of the invention.

FIG. 14A shows a non-limiting example of methodology used to design self complementary DFO constructs utilizing palindrome and/or repeat nucleic acid sequences that are identified in a target nucleic acid sequence. (i) A palindrome or repeat sequence is identified in a nucleic acid target sequence. (ii) A sequence is designed that is complementary to the target nucleic acid sequence and the palindrome sequence. (iii) An inverse repeat sequence of the non-palindrome/repeat portion of the complementary sequence is appended to the 3'-end of the complementary sequence to generate a self complementary DFO molecule comprising sequence complementary to the nucleic acid target. (iv) The DFO molecule can self-assemble to form a double stranded oligonucleotide. FIG. 14B shows a non-limiting representative example of a duplex forming oligonucleotide sequence. FIG. 14C shows a non-limiting example of the self assembly schematic of a representative duplex forming oligonucleotide sequence. FIG. 14D shows a non-limiting example of the self assembly schematic of a representative duplex forming oligonucleotide sequence followed by interaction with a target nucleic acid sequence resulting in modulation of gene expression.

FIG. 15 shows a non-limiting example of the design of self complementary DFO constructs utilizing palindrome and/or repeat nucleic acid sequences that are incorporated into the DFO constructs that have sequence complementary to any target nucleic acid sequence of interest. Incorporation of these palindrome/repeat sequences allow the design of DFO constructs that form duplexes in which each strand is capable of mediating modulation of target gene expression, for example by RNAi. First, the target sequence is identified. A complementary sequence is then generated in which nucleotide or non-nucleotide modifications (shown as X or Y) are introduced into the complementary sequence that generate an artificial palindrome (shown as XYXYXY in the Figure). An inverse repeat of the non-palindrome/repeat complementary sequence is appended to the 3'-end of the complementary sequence to generate a self complementary DFO comprising sequence complementary to the nucleic acid target. The DFO can self-assemble to form a double stranded oligonucleotide.

FIG. 16 shows non-limiting examples of multifunctional siNA molecules of the invention comprising two separate polynucleotide sequences that are each capable of mediating RNAi directed cleavage of differing target nucleic acid sequences. FIG. 16A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 16B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences.

FIG. 17 shows non-limiting examples of multifunctional siNA molecules of the invention comprising a single polynucleotide sequence comprising distinct regions that are each capable of mediating RNAi directed cleavage of differing target nucleic acid sequences. FIG. 17A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 17B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 16.

FIG. 18 shows non-limiting examples of multifunctional siNA molecules of the invention comprising two separate polynucleotide sequences that are each capable of mediating RNAi directed cleavage of differing target nucleic acid sequences and wherein the multifunctional siNA construct further comprises a self complementary, palindrome, or repeat region, thus enabling shorter bifuctional siNA constructs that can mediate RNA interference against differing target nucleic acid sequences. FIG. 18A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 18B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences.

FIG. 19 shows non-limiting examples of multifunctional siNA molecules of the invention comprising a single polynucleotide sequence comprising distinct regions that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 19A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 19B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 18.

FIG. 20 shows a non-limiting example of how multifunctional siNA molecules of the invention can target two separate target nucleic acid molecules, such as separate RNA molecules encoding differing proteins, for example, a cytokine and its corresponding receptor, differing viral strains, a virus and a cellular protein involved in viral infection or replication, or differing proteins involved in a common or divergent biologic pathway that is implicated in the maintenance of progression of disease. Each strand of the multifunctional siNA construct comprises a region having complementarity to separate target nucleic acid molecules. The multifunctional siNA molecule is designed such that each strand of the siNA can be utilized by the RISC complex to initiate RNA interference mediated cleavage of its corresponding target. These design parameters can include destabilization of each end of the siNA construct (see for example Schwarz et al., 2003, *Cell*, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 21 shows a non-limiting example of how multifunctional siNA molecules of the invention can target two separate target nucleic acid sequences within the same target nucleic acid molecule, such as alternate coding regions of a RNA, coding and non-coding regions of a RNA, or alternate splice variant regions of a RNA. Each strand of the multifunctional siNA construct comprises a region having complementarity to the separate regions of the target nucleic acid molecule. The multifunctional siNA molecule is designed such that each strand of the siNA can be utilized by the RISC complex to initiate RNA interference mediated cleavage of its corresponding target region. These design parameters can include destabilization of each end of the siNA construct (see for example Schwarz et al., 2003, *Cell*, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 22(A-H) shows non-limiting examples of tethered multifunctional siNA constructs of the invention. In the examples shown, a linker (e.g., nucleotide or non-nucleotide linker) connects two siNA regions (e.g., two sense, two antisense, or alternately a sense and an antisense region together. Separate sense (or sense and antisense) sequences corresponding to a first target sequence and second target sequence are hybridized to their corresponding sense and/or antisense sequences in the multifunctional siNA. In addition, various conjugates, ligands, aptamers, polymers or reporter molecules can be attached to the linker region for selective or improved delivery and/or pharmacokinetic properties.

FIG. 23 shows a non-limiting example of various dendrimer based multifunctional siNA designs.

FIG. 24 shows a non-limiting example of various supramolecular multifunctional siNA designs.

FIG. 25 shows a non-limiting example of a dicer enabled multifunctional siNA design using a 30 nucleotide precursor siNA construct. A 30 base pair duplex is cleaved by Dicer into 22 and 8 base pair products from either end (8 b.p. fragments not shown). For ease of presentation the overhangs generated by dicer are not shown—but can be compensated for. Three targeting sequences are shown. The required sequence identity overlapped is indicated by grey boxes. The N's of the parent 30 b.p. siNA are suggested sites of 2'-OH positions to enable Dicer cleavage if this is tested in stabilized chemistries. Note that processing of a 30 mer duplex by Dicer RNase III does not give a precise 22+8 cleavage, but rather produces a series of closely related products (with 22+8 being the primary site). Therefore, processing by Dicer will yield a series of active siNAs.

FIG. 26 shows a non-limiting example of a dicer enabled multifunctional siNA design using a 40 nucleotide precursor siNA construct. A 40 base pair duplex is cleaved by Dicer into 20 base pair products from either end. For ease of presentation the overhangs generated by dicer are not shown—but can be compensated for. Four targeting sequences are shown. The target sequences having homology are enclosed by boxes. This design format can be extended to larger RNAs. If chemically stabilized siNAs are bound by Dicer, then strategically located ribonucleotide linkages can enable designer cleavage products that permit our more extensive repertoire of multifunctional designs. For example cleavage products not limited to the Dicer standard of approximately 22-nucleotides can allow multifunctional siNA constructs with a target sequence identity overlap ranging from, for example, about 3 to about 15 nucleotides.

FIG. 27 shows a non-limiting example of additional multifunctional siNA construct designs of the invention. In one example, a conjugate, ligand, aptamer, label, or other moiety is attached to a region of the multifunctional siNA to enable improved delivery or pharmacokinetic profiling.

FIG. 28 shows a non-limiting example of additional multifunctional siNA construct designs of the invention. In one example, a conjugate, ligand, aptamer, label, or other moiety is attached to a region of the multifunctional siNA to enable improved delivery or pharmacokinetic profiling.

FIG. 29 shows a non-limiting example of a cholesterol linked phosphoramidite that can be used to synthesize cholesterol conjugated siNA molecules of the invention. An example is shown with the cholesterol moiety linked to the 5'-end of the sense strand of a siNA molecule.

FIG. 30 shows a non-limiting example of demonstrated stabilization of visual acuity (VA) in all patients treated with Sirna-027 in a Phase I clinical study, with a variable mean increase of number of letters read for each dose group, and a duration of effect sustained over 8 weeks post-injection.

FIG. 31 shows a non-limiting example of assessment of visual acuity (VA) at 8 weeks post dosing in patients treated with Sirna-027 in a Phase I clinical study, VA (number of lines read) was stable or improved in 100% of the patients, while a clinically significant improvement (equal to or more than 3 lines) was observed in 23% of patients.

FIG. 32 shows a non-limiting example of changes in foveal thickness for the first four dose groups (100, 200, 400 and 800

μg) in patients treated with Sirna-027 in a Phase I clinical study, in which treatment with Sirna-027 demonstrated a decrease of lesion thickness for the 100, 200 and 800 μg dose groups, with maximum effect by 14 days post-injection.

DETAILED DESCRIPTION OF THE INVENTION

Mechanism of Action of Nucleic Acid Molecules of the Invention

The discussion that follows discusses the proposed mechanism of RNA interference mediated by short interfering RNA as is presently known, and is not meant to be limiting and is not an admission of prior art. Applicant demonstrates herein that chemically-modified short interfering nucleic acids possess similar or improved capacity to mediate RNAi as do siRNA molecules and are expected to possess improved stability and activity in vivo; therefore, this discussion is not meant to be limiting only to siRNA and can be applied to siNA as a whole. By "improved capacity to mediate RNAi" or "improved RNAi activity" is meant to include RNAi activity measured in vitro and/or in vivo where the RNAi activity is a reflection of both the ability of the siNA to mediate RNAi and the stability of the siNAs of the invention. In this invention, the product of these activities can be increased in vitro and/or in vivo compared to an all RNA siRNA or a siNA containing a plurality of ribonucleotides. In some cases, the activity or stability of the siNA molecule can be decreased (i.e., less than ten-fold), but the overall activity of the siNA molecule is enhanced in vitro and/or in vivo.

RNA interference refers to the process of sequence specific post-transcriptional gene silencing in animals mediated by short interfering RNAs (siRNAs) (Fire et al., 1998, *Nature*, 391, 806). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes which is commonly shared by diverse flora and phyla (Fire et al., 1999, *Trends Genet.*, 15, 358). Such protection from foreign gene expression may have evolved in response to the production of double-stranded RNAs (dsRNAs) derived from viral infection or the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA-mediated activation of protein kinase PKR and 2', 5'-oligoadenylate synthetase resulting in non-specific cleavage of mRNA by ribonuclease L.

The presence of long dsRNAs in cells stimulates the activity of a ribonuclease III enzyme referred to as Dicer. Dicer is involved in the processing of the dsRNA into short pieces of dsRNA known as short interfering RNAs (siRNAs) (Berstein et al., 2001, *Nature*, 409, 363). Short interfering RNAs derived from Dicer activity are typically about 21 to about 23 nucleotides in length and comprise about 19 base pair duplexes. Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex containing a siRNA, commonly referred to as an RNA-induced silencing complex (RISC), which mediates cleavage of single-stranded RNA having sequence homologous to the siRNA. Cleavage of the target RNA takes place in the middle of the region complementary to the guide sequence of the siRNA duplex (Elbashir et al., 2001, *Genes Dev.*, 15, 188). In addition, RNA interference can also involve small RNA (e.g., micro-RNA or miRNA) mediated gene silencing, presumably though cellular mechanisms that regulate chromatin structure and thereby prevent transcription of target gene sequences (see for example Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). As such, siNA molecules of the invention can be used to mediate gene silencing via interaction with RNA transcripts or alternately by interaction with particular gene sequences, wherein such interaction results in gene silencing either at the transcriptional level or post-transcriptional level.

RNAi has been studied in a variety of systems. Fire et al., 1998, *Nature*, 391, 806, were the first to observe RNAi in *C. elegans*. Wianny and Goetz, 1999, *Nature Cell Biol.*, 2, 70, describe RNAi mediated by dsRNA in mouse embryos. Hammond et al., 2000, *Nature*, 404, 293, describe RNAi in *Drosophila* cells transfected with dsRNA. Elbashir et al., 2001, *Nature*, 411, 494, describe RNAi induced by introduction of duplexes of synthetic 21-nucleotide RNAs in cultured mammalian cells including human embryonic kidney and HeLa cells. Recent work in *Drosophila* embryonic lysates has revealed certain requirements for siRNA length, structure, chemical composition, and sequence that are essential to mediate efficient RNAi activity. These studies have shown that 21 nucleotide siRNA duplexes are most active when containing two 2-nucleotide 3'-terminal nucleotide overhangs. Furthermore, substitution of one or both siRNA strands with 2'-deoxy or 2'-O-methyl nucleotides abolishes RNAi activity, whereas substitution of 3'-terminal siRNA nucleotides with deoxy nucleotides was shown to be tolerated. Mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end (Elbashir et al., 2001, *EMBO J.*, 20, 6877). Other studies have indicated that a 5'-phosphate on the target-complementary strand of a siRNA duplex is required for siRNA activity and that ATP is utilized to maintain the 5'-phosphate moiety on the siRNA (Nykanen et al., 2001, *Cell*, 107, 309); however, siRNA molecules lacking a 5'-phosphate are active when introduced exogenously, suggesting that 5'-phosphorylation of siRNA constructs may occur in vivo.

Duplex Forming Oligonucleotides (DFO) of the Invention

In one embodiment, the invention features siNA molecules comprising duplex forming oligonucleotides (DFO) that can self-assemble into double stranded oligonucleotides. The duplex forming oligonucleotides of the invention can be chemically synthesized or expressed from transcription units and/or vectors. The DFO molecules of the instant invention provide useful reagents and methods for a variety of therapeutic, diagnostic, agricultural, veterinary, target validation, genomic discovery, genetic engineering and pharmacogenomic applications.

Applicant demonstrates herein that certain oligonucleotides, referred to herein for convenience but not limitation as duplex forming oligonucleotides or DFO molecules, are potent mediators of sequence specific regulation of gene expression. The oligonucleotides of the invention are distinct from other nucleic acid sequences known in the art (e.g., siRNA, miRNA, stRNA, shRNA, antisense oligonucleotides etc.) in that they represent a class of linear polynucleotide sequences that are designed to self-assemble into double stranded oligonucleotides, where each strand in the double stranded oligonucleotides comprises a nucleotide sequence that is complementary to a target nucleic acid molecule. Nucleic acid molecules of the invention can thus self assemble into functional duplexes in which each strand of the duplex comprises the same polynucleotide sequence and each strand comprises a nucleotide sequence that is complementary to a target nucleic acid molecule.

Generally, double stranded oligonucleotides are formed by the assembly of two distinct oligonucleotide sequences where the oligonucleotide sequence of one strand is complementary to the oligonucleotide sequence of the second strand; such double stranded oligonucleotides are assembled from two separate oligonucleotides, or from a single molecule that folds on itself to form a double stranded structure, often referred to in the field as hairpin stem-loop structure (e.g., shRNA or short hairpin RNA). These double stranded oligonucleotides known in the art all have a common feature in that each strand of the duplex has a distinct nucleotide sequence.

Distinct from the double stranded nucleic acid molecules known in the art, the applicants have developed a novel, potentially cost effective and simplified method of forming a double stranded nucleic acid molecule starting from a single stranded or linear oligonucleotide. The two strands of the double stranded oligonucleotide formed according to the instant invention have the same nucleotide sequence and are not covalently linked to each other. Such double-stranded oligonucleotides molecules can be readily linked post-synthetically by methods and reagents known in the art and are within the scope of the invention. In one embodiment, the single stranded oligonucleotide of the invention (the duplex forming oligonucleotide) that forms a double stranded oligonucleotide comprises a first region and a second region, where the second region includes a nucleotide sequence that is an inverted repeat of the nucleotide sequence in the first region, or a portion thereof, such that the single stranded oligonucleotide self assembles to form a duplex oligonucleotide in which the nucleotide sequence of one strand of the duplex is the same as the nucleotide sequence of the second strand. Non-limiting examples of such duplex forming oligonucleotides are illustrated in FIGS. 14 and 15. These duplex forming oligonucleotides (DFOs) can optionally include certain palindrome or repeat sequences where such palindrome or repeat sequences are present in between the first region and the second region of the DFO.

In one embodiment, the invention features a duplex forming oligonucleotide (DFO) molecule, wherein the DFO comprises a duplex forming self complementary nucleic acid sequence that has nucleotide sequence complementary to a target nucleic acid sequence. The DFO molecule can comprise a single self complementary sequence or a duplex resulting from assembly of such self complementary sequences.

In one embodiment, a duplex forming oligonucleotide (DFO) of the invention comprises a first region and a second region, wherein the second region comprises a nucleotide sequence comprising an inverted repeat of nucleotide sequence of the first region such that the DFO molecule can assemble into a double stranded oligonucleotide. Such double stranded oligonucleotides can act as a short interfering nucleic acid (siNA) to modulate gene expression. Each strand of the double stranded oligonucleotide duplex formed by DFO molecules of the invention can comprise a nucleotide sequence region that is complementary to the same nucleotide sequence in a target nucleic acid molecule (e.g., target RNA).

In one embodiment, the invention features a single stranded DFO that can assemble into a double stranded oligonucleotide. The applicant has surprisingly found that a single stranded oligonucleotide with nucleotide regions of self complementarity can readily assemble into duplex oligonucleotide constructs. Such DFOs can assemble into duplexes that can inhibit gene expression in a sequence specific manner. The DFO molecules of the invention comprise a first region with nucleotide sequence that is complementary to the nucleotide sequence of a second region and where the sequence of the first region is complementary to a target nucleic acid. The DFO can form a double stranded oligonucleotide wherein a portion of each strand of the double stranded oligonucleotide comprises a sequence complementary to a target nucleic acid sequence.

In one embodiment, the invention features a double stranded oligonucleotide, wherein the two strands of the double stranded oligonucleotide are not covalently linked to each other, and wherein each strand of the double stranded oligonucleotide comprises a nucleotide sequence that is complementary to the same nucleotide sequence in a target nucleic acid molecule or a portion thereof (e.g., VEGF and/or VEGFR RNA target). In another embodiment, the two strands of the double stranded oligonucleotide share an identical nucleotide sequence of at least about 15, preferably at least about 16, 17, 18, 19, 20, or 21 nucleotides.

In one embodiment, a DFO molecule of the invention comprises a structure having Formula DFO-I:

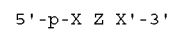

wherein Z comprises a palindromic or repeat nucleic acid sequence optionally with one or more modified nucleotides (e.g., nucleotide with a modified base, such as 2-amino purine, 2-amino-1,6-dihydro purine or a universal base), for example of length about 2 to about 24 nucleotides in even numbers (e.g., about 2, 4, 6, 8, 10, 12, 14, 16, 18, 20, or 22 or 24 nucleotides), X represents a nucleic acid sequence, for example of length of about 1 to about 21 nucleotides (e.g., about 1, 2, 3, 4, 5, 6, 7, 8, 9, 10, 11, 12, 13, 14, 15, 16, 17, 18, 19, 20, or 21 nucleotides), X' comprises a nucleic acid sequence, for example of length about 1 and about 21 nucleotides (e.g., about 1, 2, 3, 4, 5, 6, 7, 8, 9, 10, 11, 12, 13, 14, 15, 16, 17, 18, 19, 20 or 21 nucleotides) having nucleotide sequence complementarity to sequence X or a portion thereof, p comprises a terminal phosphate group that can be present or absent, and wherein sequence X and Z, either independently or together, comprise nucleotide sequence that is complementary to a target nucleic acid sequence or a portion thereof and is of length sufficient to interact (e.g., base pair) with the target nucleic acid sequence or a portion thereof (e.g., VEGF and/or VEGFR RNA target). For example, X independently can comprise a sequence from about 12 to about 21 or more (e.g., about 12, 13, 14, 15, 16, 17, 18, 19, 20, 21, or more) nucleotides in length that is complementary to nucleotide sequence in a target RNA or a portion thereof. In another non-limiting example, the length of the nucleotide sequence of X and Z together, when X is present, that is complementary to the target RNA or a portion thereof (e.g., VEGF and/or VEGFR RNA target) is from about 12 to about 21 or more nucleotides (e.g., about 12, 13, 14, 15, 16, 17, 18, 19, 20, 21, or more). In yet another non-limiting example, when X is absent, the length of the nucleotide sequence of Z that is complementary to the target RNA or a portion thereof is from about 12 to about 24 or more nucleotides (e.g., about 12, 14, 16, 18, 20, 22, 24, or more). In one embodiment X, Z and X' are independently oligonucleotides, where X and/or Z comprises a nucleotide sequence of length sufficient to interact (e.g., base pair) with a nucleotide sequence in the target RNA or a portion thereof (e.g., VEGF and/or VEGFR RNA target). In one embodiment, the lengths of oligonucleotides X and X' are identical. In another embodiment, the lengths of oligonucleotides X and X' are not identical. In another embodiment, the lengths of oligonucleotides X and Z, or Z and X', or X, Z and X' are either identical or different.

When a sequence is described in this specification as being of "sufficient" length to interact (i.e., base pair) with another sequence, it is meant that the length is such that the number of bonds (e.g., hydrogen bonds) formed between the two sequences is enough to enable the two sequence to form a duplex under the conditions of interest. Such conditions can be in vitro (e.g., for diagnostic or assay purposes) or in vivo (e.g., for therapeutic purposes). It is a simple and routine matter to determine such lengths.

In one embodiment, the invention features a double stranded oligonucleotide construct having Formula DFO-I (a):

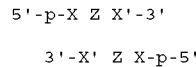

wherein Z comprises a palindromic or repeat nucleic acid sequence or palindromic or repeat-like nucleic acid sequence with one or more modified nucleotides (e.g., nucleotides with a modified base, such as 2-amino purine, 2-amino-1,6-dihydro purine or a universal base), for example of length about 2 to about 24 nucleotides in even numbers (e.g., about 2, 4, 6, 8, 10, 12, 14, 16, 18, 20, 22 or 24 nucleotides), X represents a nucleic acid sequence, for example of length about 1 to about 21 nucleotides (e.g., about 1, 2, 3, 4, 5, 6, 7, 8, 9, 10, 11, 12, 13, 14, 15, 16, 17, 18, 19, 20, or 21 nucleotides), X' comprises a nucleic acid sequence, for example of length about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) having nucleotide sequence complementarity to sequence X or a portion thereof, p comprises a terminal phosphate group that can be present or absent, and wherein each X and Z independently comprises a nucleotide sequence that is complementary to a target nucleic acid sequence or a portion thereof (e.g., VEGF and/or VEGFR RNA target) and is of length sufficient to interact with the target nucleic acid sequence of a portion thereof (e.g., VEGF and/or VEGFR RNA target). For example, sequence X independently can comprise a sequence from about 12 to about 21 or more nucleotides (e.g., about 12, 13, 14, 15, 16, 17, 18, 19, 20, 21, or more) in length that is complementary to a nucleotide sequence in a target RNA or a portion thereof (e.g., VEGF and/or VEGFR RNA target). In another non-limiting example, the length of the nucleotide sequence of X and Z together (when X is present) that is complementary to the target RNA or a portion thereof is from about 12 to about 21 or more nucleotides (e.g., about 12, 13, 14, 15, 16, 17, 18, 19, 20, 21, or more). In yet another non-limiting example, when X is absent, the length of the nucleotide sequence of Z that is complementary to the target RNA or a portion thereof is from about 12 to about 24 or more nucleotides (e.g., about 12, 14, 16, 18, 20, 22, 24 or more). In one embodiment X, Z and X' are independently oligonucleotides, where X and/or Z comprises a nucleotide sequence of length sufficient to interact (e.g., base pair) with nucleotide sequence in the target RNA or a portion thereof (e.g., VEGF and/or VEGFR RNA target). In one embodiment, the lengths of oligonucleotides X and X' are identical. In another embodiment, the lengths of oligonucleotides X and X' are not identical. In another embodiment, the lengths of oligonucleotides X and Z or Z and X' or X, Z and X' are either identical or different. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a DFO molecule of the invention comprises structure having Formula DFO-II:

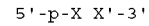

wherein each X and X' are independently oligonucleotides of length about 12 nucleotides to about 21 nucleotides, wherein X comprises, for example, a nucleic acid sequence of length about 12 to about 21 nucleotides (e.g., about 12, 13, 14, 15, 16, 17, 18, 19, 20 or 21 nucleotides), X' comprises a nucleic acid sequence, for example of length about 12 to about 21 nucleotides (e.g., about 12, 13, 14, 15, 16, 17, 18, 19, 20, or 21 nucleotides) having nucleotide sequence complementarity to sequence X or a portion thereof, p comprises a terminal phosphate group that can be present or absent, and wherein X comprises a nucleotide sequence that is complementary to a target nucleic acid sequence (e.g., target RNA) or a portion thereof and is of length sufficient to interact (e.g., base pair) with the target nucleic acid sequence of a portion thereof. In one embodiment, the length of oligonucleotides X and X' are identical. In another embodiment the length of oligonucleotides X and X' are not identical. In one embodiment, length of the oligonucleotides X and X' are sufficient to form a relatively stable double stranded oligonucleotide.

In one embodiment, the invention features a double stranded oligonucleotide construct having Formula DFO-II (a):

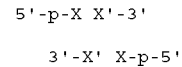

wherein each X and X' are independently oligonucleotides of length about 12 nucleotides to about 21 nucleotides, wherein X comprises a nucleic acid sequence, for example of length about 12 to about 21 nucleotides (e.g., about 12, 13, 14, 15, 16, 17, 18, 19, 20 or 21 nucleotides), X' comprises a nucleic acid sequence, for example of length about 12 to about 21 nucleotides (e.g., about 12, 13, 14, 15, 16, 17, 18, 19, 20 or 21 nucleotides) having nucleotide sequence complementarity to sequence X or a portion thereof, p comprises a terminal phosphate group that can be present or absent, and wherein X comprises nucleotide sequence that is complementary to a target nucleic acid sequence or a portion thereof (e.g., VEGF and/or VEGFR RNA target) and is of length sufficient to interact (e.g., base pair) with the target nucleic acid sequence (e.g., target RNA) or a portion thereof. In one embodiment, the lengths of oligonucleotides X and X' are identical. In another embodiment, the lengths of oligonucleotides X and X' are not identical. In one embodiment, the lengths of the oligonucleotides X and X' are sufficient to form a relatively stable double stranded oligonucleotide. In one embodiment, the double stranded oligonucleotide construct of Formula II(a) includes one or more, specifically 1, 2, 3 or 4, mismatches, to the extent such mismatches do not significantly diminish the ability of the double stranded oligonucleotide to inhibit target gene expression.

In one embodiment, the invention features a DFO molecule having Formula DFO-I(b):

$$5'-p-Z-3'$$

where Z comprises a palindromic or repeat nucleic acid sequence optionally including one or more non-standard or modified nucleotides (e.g., nucleotide with a modified base, such as 2-amino purine or a universal base) that can facilitate base-pairing with other nucleotides. Z can be, for example, of length sufficient to interact (e.g., base pair) with nucleotide sequence of a target nucleic acid (e.g., target RNA) molecule, preferably of length of at least 12 nucleotides, specifically about 12 to about 24 nucleotides (e.g., about 12, 14, 16, 18, 20, 22 or 24 nucleotides). p represents a terminal phosphate group that can be present or absent.

In one embodiment, a DFO molecule having any of Formula DFO-I, DFO-I(a), DFO-I(b), DFO-II(a) or DFO-II can comprise chemical modifications as described herein without limitation, such as, for example, nucleotides having any of Formulae I-VII, stabilization chemistries as described in Table IV, or any other combination of modified nucleotides and non-nucleotides as described in the various embodiments herein.

In one embodiment, the palindrome or repeat sequence or modified nucleotide (e.g., nucleotide with a modified base, such as 2-amino purine or a universal base) in Z of DFO constructs having Formula DFO-I, DFO-I(a) and DFO-I(b), comprises chemically modified nucleotides that are able to interact with a portion of the target nucleic acid sequence (e.g., modified base analogs that can form Watson Crick base pairs or non-Watson Crick base pairs).

In one embodiment, a DFO molecule of the invention, for example a DFO having Formula DFO-I or DFO-II, comprises about 15 to about 40 nucleotides (e.g., about 15, 16, 17, 18, 19, 20, 21, 22, 23, 24, 25, 26, 27, 28, 29, 30, 31, 32, 33, 34, 35, 36, 37, 38, 39, or 40 nucleotides). In one embodiment, a DFO molecule of the invention comprises one or more chemical modifications. In a non-limiting example, the introduction of chemically modified nucleotides and/or non-nucleotides into nucleic acid molecules of the invention provides a powerful tool in overcoming potential limitations of in vivo stability and bioavailability inherent to unmodified RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum or in cells or tissues. Furthermore, certain chemical modifications can improve the bioavailability and/or potency of nucleic acid molecules by not only enhancing half-life but also facilitating the targeting of nucleic acid molecules to particular organs, cells or tissues and/or improving cellular uptake of the nucleic acid molecules. Therefore, even if the activity of a chemically modified nucleic acid molecule is reduced in vitro as compared to a native/unmodified nucleic acid molecule, for example when compared to an unmodified RNA molecule, the overall activity of the modified nucleic acid molecule can be greater than the native or unmodified nucleic acid molecule due to improved stability, potency, duration of effect, bioavailability and/or delivery of the molecule.

Multifunctional or Multi-Targeted siNA Molecules of the Invention

In one embodiment, the invention features siNA molecules comprising multifunctional short interfering nucleic acid (multifunctional siNA) molecules that modulate the expression of one or more genes in a biologic system, such as a cell, tissue, or organism. The multifunctional short interfering nucleic acid (multifunctional siNA) molecules of the invention can target more than one region a VEGF and/or VEGFR target nucleic acid sequence or can target sequences of more than one distinct target nucleic acid molecules (e.g., VEGF, VEGFR, interleukin (e.g., IL-4, IL-13), or interleukin receptor (e.g., IL-4R, IL-13R)RNA targets). The multifunctional siNA molecules of the invention can be chemically synthesized or expressed from transcription units and/or vectors. The multifunctional siNA molecules of the instant invention provide useful reagents and methods for a variety of human applications, therapeutic, diagnostic, agricultural, veterinary, target validation, genomic discovery, genetic engineering and pharmacogenomic applications.

Applicant demonstrates herein that certain oligonucleotides, referred to herein for convenience but not limitation as multifunctional short interfering nucleic acid or multifunctional siNA molecules, are potent mediators of sequence specific regulation of gene expression. The multifunctional siNA molecules of the invention are distinct from other nucleic acid sequences known in the art (e.g., siRNA, miRNA, stRNA, shRNA, antisense oligonucleotides, etc.) in that they represent a class of polynucleotide molecules that are designed such that each strand in the multifunctional siNA construct comprises a nucleotide sequence that is complementary to a distinct nucleic acid sequence in one or more target nucleic acid molecules. A single multifunctional siNA molecule (generally a double-stranded molecule) of the invention can thus target more than one (e.g., 2, 3, 4, 5, or more) differing target nucleic acid target molecules. Nucleic acid molecules of the invention can also target more than one (e.g., 2, 3, 4, 5, or more) region of the same target nucleic acid sequence. As such multifunctional siNA molecules of the invention are useful in down regulating or inhibiting the expression of one or more target nucleic acid molecules. For example, a multifunctional siNA molecule of the invention can target nucleic acid molecules encoding a cytokine and its corresponding receptor(s) (e.g., VEGF and VEGF receptors and interleukins (e.g., IL-4, IL-13) and interleukin receptors (e.g., IL-4R, IL-13R) described herein). By reducing or inhibiting expression of more than one target nucleic acid molecule with one multifunctional siNA construct, multifunctional siNA molecules of the invention represent a class of potent therapeutic agents that can provide simultaneous inhibition of multiple targets within a disease or pathogen related pathway. Such simultaneous inhibition can provide synergistic therapeutic treatment strategies without the need for separate preclinical and clinical development efforts or complex regulatory approval process.

Use of multifunctional siNA molecules that target more then one region of a target nucleic acid molecule (e.g., messenger RNA) is expected to provide potent inhibition of gene expression. For example, a single multifunctional siNA construct of the invention can target both conserved and variable regions of a target nucleic acid molecule (e.g., VEGF and/or VEGFR RNA and/or interleukin and/or interleukin receptor RNA), thereby allowing down regulation or inhibition of different splice variants encoded by a single gene, or allowing for targeting of both coding and non-coding regions of a target nucleic acid molecule.

Generally, double stranded oligonucleotides are formed by the assembly of two distinct oligonucleotides where the oligonucleotide sequence of one strand is complementary to the oligonucleotide sequence of the second strand; such double stranded oligonucleotides are generally assembled from two separate oligonucleotides (e.g., siRNA). Alternately, a duplex can be formed from a single molecule that folds on itself (e.g., shRNA or short hairpin RNA). These double stranded oligonucleotides are known in the art to mediate RNA interference and all have a common feature wherein only one nucleotide sequence region (guide sequence or the antisense sequence) has complementarity to a target nucleic acid sequence (e.g., VEGF and/or VEGFR RNA and/or interleukin and/or interleukin receptor RNA) and the other strand (sense sequence) comprises nucleotide sequence that is homologous to the target nucleic acid sequence. Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example Schwarz et al., 2003, Cell, 115, 199-208). In this instance the sense sequence is believed to direct the RISC complex to a sequence (off-target sequence) that is distinct from the intended target sequence, resulting in the inhibition of the off-target sequence. In these double stranded nucleic acid molecules, each strand is complementary to a distinct target nucleic acid sequence. However, the off-targets that are affected by these dsRNAs are not entirely predictable and are non-specific.

Distinct from the double stranded nucleic acid molecules known in the art, the applicants have developed a novel, potentially cost effective and simplified method of down regulating or inhibiting the expression of more than one target nucleic acid sequence using a single multifunctional siNA construct. The multifunctional siNA molecules of the invention are designed to be double-stranded or partially double stranded, such that a portion of each strand or region of the multifunctional siNA is complementary to a target nucleic acid sequence of choice. As such, the multifunctional siNA molecules of the invention are not limited to targeting sequences that are complementary to each other, but rather to any two differing target nucleic acid sequences. Multifunctional siNA molecules of the invention are designed such that each strand or region of the multifunctional siNA molecule, that is complementary to a given target nucleic acid sequence, is of suitable length (e.g., from about 16 to about 28 nucleotides in length, preferably from about 18 to about 28 nucleotides in length) for mediating RNA interference against the target nucleic acid sequence. The complementarity between the target nucleic acid sequence and a strand or region of the multifunctional siNA must be sufficient (at least about 8 base pairs) for cleavage of the target nucleic acid sequence by RNA interference. multifunctional siNA of the invention is expected to minimize off-target effects seen with certain siRNA sequences, such as those described in (Schwarz et al., supra).

It has been reported that dsRNAs of length between 29 base pairs and 36 base pairs (Tuschl et al., International PCT Publication No. WO 02/44321) do not mediate RNAi. One reason these dsRNAs are inactive may be the lack of turnover or dissociation of the strand that interacts with the target RNA sequence, such that the RISC complex is not able to efficiently interact with multiple copies of the target RNA resulting in a significant decrease in the potency and efficiency of the RNAi process. Applicant has surprisingly found that the multifunctional siNAs of the invention can overcome this hurdle and are capable of enhancing the efficiency and potency of RNAi process. As such, in certain embodiments of the invention, multifunctional siNAs of length of about 29 to about 36 base pairs can be designed such that, a portion of each strand of the multifunctional siNA molecule comprises a nucleotide sequence region that is complementary to a target nucleic acid of length sufficient to mediate RNAi efficiently (e.g., about 15 to about 23 base pairs) and a nucleotide sequence region that is not complementary to the target nucleic acid. By having both complementary and non-complementary portions in each strand of the multifunctional siNA, the multifunctional siNA can mediate RNA interference against a target nucleic acid sequence without being prohibitive to turnover or dissociation (e.g., where the length of each strand is too long to mediate RNAi against the respective target nucleic acid sequence). Furthermore, design of multifunctional siNA molecules of the invention with internal overlapping regions allows the multifunctional siNA molecules to be of favorable (decreased) size for mediating RNA interference and of size that is well suited for use as a therapeutic agent (e.g., wherein each strand is independently from about 18 to about 28 nucleotides in length). Non-limiting examples are illustrated in the enclosed FIGS. 16-21.

In one embodiment, a multifunctional siNA molecule of the invention comprises a first region and a second region, where the first region of the multifunctional siNA comprises a nucleotide sequence complementary to a nucleic acid sequence of a first target nucleic acid molecule, and the second region of the multifunctional siNA comprises nucleic acid sequence complementary to a nucleic acid sequence of a second target nucleic acid molecule. In one embodiment, a multifunctional siNA molecule of the invention comprises a first region and a second region, where the first region of the multifunctional siNA comprises nucleotide sequence complementary to a nucleic acid sequence of the first region of a target nucleic acid molecule, and the second region of the multifunctional siNA comprises nucleotide sequence complementary to a nucleic acid sequence of a second region of a the target nucleic acid molecule. In another embodiment, the first region and second region of the multifunctional siNA can comprise separate nucleic acid sequences that share some degree of complementarity (e.g., from about 1 to about 10 complementary nucleotides). In certain embodiments, multifunctional siNA constructs comprising separate nucleic acid sequences can be readily linked post-synthetically by methods and reagents known in the art and such linked constructs are within the scope of the invention. Alternately, the first region and second region of the multifunctional siNA can comprise a single nucleic acid sequence having some degree of self complementarity, such as in a hairpin or stem-loop structure. Non-limiting examples of such double stranded and hairpin multifunctional short interfering nucleic acids are illustrated in FIGS. 16 and 17 respectively. These multifunctional short interfering nucleic acids (multifunctional siNAs) can optionally include certain overlapping nucleotide sequence where such overlapping nucleotide sequence is present in between the first region and the second region of the multifunctional siNA (see for example FIGS. 18 and 19).

In one embodiment, the invention features a multifunctional short interfering nucleic acid (multifunctional siNA) molecule, wherein each strand of the multifunctional siNA independently comprises a first region of nucleic acid sequence that is complementary to a distinct target nucleic acid sequence and the second region of nucleotide sequence that is not complementary to the target sequence. The target nucleic acid sequence of each strand is in the same target nucleic acid molecule or different target nucleic acid molecules.

In another embodiment, the multifunctional siNA comprises two strands, where: (a) the first strand comprises a region having sequence complementarity to a target nucleic acid sequence (complementary region 1) and a region having no sequence complementarity to the target nucleotide sequence (non-complementary region 1); (b) the second strand of the multifunction siNA comprises a region having sequence complementarity to a target nucleic acid sequence that is distinct from the target nucleotide sequence complementary to the first strand nucleotide sequence (complementary region 2), and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to a nucleotide sequence in the non-complementary region 1 of the first strand. The target nucleic acid sequence of complementary region 1 and complementary region 2 is in the same target nucleic acid molecule or different target nucleic acid molecules.

In another embodiment, the multifunctional siNA comprises two strands, where: (a) the first strand comprises a region having sequence complementarity to a target nucleic acid sequence derived from a gene (e.g., VEGF, VEGFR, interleukin, and/or interleukin receptor gene) (complementary region 1) and a region having no sequence complementarity to the target nucleotide sequence of complementary region 1 (non-complementary region 1); (b) the second strand of the multifunction siNA comprises a region having sequence complementarity to a target nucleic acid sequence derived from a gene that is distinct from the gene of complementary region 1 (complementary region 2), and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to a nucleotide sequence in the non-complementary region 1 of the first strand.

In another embodiment, the multifunctional siNA comprises two strands, where: (a) the first strand comprises a region having sequence complementarity to a target nucleic acid sequence derived from a gene (e.g., VEGF, VEGFR, interleukin, and/or interleukin receptor gene) (complementary region 1) and a region having no sequence complementarity to the target nucleotide sequence of complementary region 1 (non-complementary region 1); (b) the second strand of the multifunction siNA comprises a region having sequence complementarity to a target nucleic acid sequence distinct from the target nucleic acid sequence of complementary region 1 (complementary region 2), provided, however, that the target nucleic acid sequence for complementary region 1 and target nucleic acid sequence for complementary region 2 are both derived from the same gene, and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to nucleotide sequence in the non-complementary region 1 of the first strand.

In one embodiment, the invention features a multifunctional short interfering nucleic acid (multifunctional siNA) molecule, wherein the multifunctional siNA comprises two complementary nucleic acid sequences in which the first sequence comprises a first region having nucleotide sequence complementary to nucleotide sequence within a target nucleic acid molecule, and in which the second sequence comprises a first region having nucleotide sequence complementary to a distinct nucleotide sequence within the same target nucleic acid molecule. Preferably, the first region of the first sequence is also complementary to the nucleotide sequence of the second region of the second sequence, and where the first region of the second sequence is complementary to the nucleotide sequence of the second region of the first sequence, In one embodiment, the invention features a multifunctional short interfering nucleic acid (multifunctional siNA) molecule, wherein the multifunctional siNA comprises two complementary nucleic acid sequences in which the first sequence comprises a first region having a nucleotide sequence complementary to a nucleotide sequence within a first target nucleic acid molecule, and in which the second sequence comprises a first region having a nucleotide sequence complementary to a distinct nucleotide sequence within a second target nucleic acid molecule. Preferably, the first region of the first sequence is also complementary to the nucleotide sequence of the second region of the second sequence, and where the first region of the second sequence is complementary to the nucleotide sequence of the second region of the first sequence, In one embodiment, the invention features a multifunctional siNA molecule comprising a first region and a second region, where the first region comprises a nucleic acid sequence having about 18 to about 28 nucleotides complementary to a nucleic acid sequence within a first target nucleic acid molecule, and the second region comprises nucleotide sequence having about 18 to about 28 nucleotides complementary to a distinct nucleic acid sequence within a second target nucleic acid molecule.

In one embodiment, the invention features a multifunctional siNA molecule comprising a first region and a second region, where the first region comprises nucleic acid sequence having about 18 to about 28 nucleotides complementary to a nucleic acid sequence within a target nucleic acid molecule, and the second region comprises nucleotide sequence having about 18 to about 28 nucleotides complementary to a distinct nucleic acid sequence within the same target nucleic acid molecule.

In one embodiment, the invention features a double stranded multifunctional short interfering nucleic acid (multifunctional siNA) molecule, wherein one strand of the multifunctional siNA comprises a first region having nucleotide sequence complementary to a first target nucleic acid sequence, and the second strand comprises a first region having a nucleotide sequence complementary to a second target nucleic acid sequence. The first and second target nucleic acid sequences can be present in separate target nucleic acid molecules or can be different regions within the same target nucleic acid molecule. As such, multifunctional siNA molecules of the invention can be used to target the expression of different genes, splice variants of the same gene, both mutant and conserved regions of one or more gene transcripts, or both coding and non-coding sequences of the same or differing genes or gene transcripts.

In one embodiment, a target nucleic acid molecule of the invention encodes a single protein. In another embodiment, a target nucleic acid molecule encodes more than one protein (e.g., 1, 2, 3, 4, 5 or more proteins). As such, a multifunctional siNA construct of the invention can be used to down regulate or inhibit the expression of several proteins. For example, a multifunctional siNA molecule comprising a region in one strand having nucleotide sequence complementarity to a first target nucleic acid sequence derived from a gene encoding one protein (e.g., a cytokine, such as vascular endothelial growth factor or VEGF) and the second strand comprising a region with nucleotide sequence complementarity to a second target nucleic acid sequence present in target nucleic acid molecules derived from genes encoding two proteins (e.g., two differing receptors, such as VEGF receptor 1 and VEGF receptor 2, for a single cytokine, such as VEGF) can be used to down regulate, inhibit, or shut down a particular biologic pathway by targeting, for example, a cytokine and receptors for the cytokine, or a ligand and receptors for the ligand.

In one embodiment the invention takes advantage of conserved nucleotide sequences present in different isoforms of cytokines or ligands and receptors for the cytokines or ligands. By designing multifunctional siNAs in a manner where one strand includes a sequence that is complementary to a target nucleic acid sequence conserved among various isoforms of a cytokine and the other strand includes sequence that is complementary to a target nucleic acid sequence conserved among the receptors for the cytokine, it is possible to selectively and effectively modulate or inhibit a biological pathway or multiple genes in a biological pathway using a single multifunctional siNA.

In another nonlimiting example, a multifunctional siNA molecule comprising a region in one strand having a nucleotide sequence complementarity to a first target nucleic acid sequence present in target nucleic acid molecules encoding two proteins (e.g., two isoforms of a cytokine such as VEGF, including for example any of VEGF-A, VEGF-B, VEGF-C, and/or VEGF-D) and the second strand comprising a region with a nucleotide sequence complementarity to a second target nucleic acid sequence present in target nucleotide molecules encoding two additional proteins (e.g., two differing receptors for the cytokine, such as VEGFR1, VEGFR2, and/or VEGFR3) can be used to down regulate, inhibit, or shut down a particular biologic pathway by targeting different isoforms of a cytokine and receptors for such cytokines.

In one embodiment, a multifunctional short interfering nucleic acid (multifunctional siNA) of the invention comprises a region in each strand, wherein the region in one strand comprises nucleotide sequence complementary to a cytokine and the region in the second strand comprises nucleotide sequence complementary to a corresponding receptor for the cytokine. Non-limiting examples of cytokines include vascular endothelial growth factors (e.g., VEGF-A, VEGF-B, VEGF-C, VEGF-D) and/or interleukins (e.g., IL-4, IL-13) and non-limiting examples of cytokine receptors include VEGFR1, VEGFR2, and VEGFR3 and/or IL-4 and IL-13R.

In one embodiment, a double stranded multifunctional siNA molecule of the invention comprises a structure having Formula MF-I:

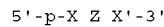

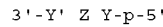

wherein each 5'-p-XZX'-3' and 5'-p-YZY'-3' are independently an oligonucleotide of length of about 20 nucleotides to about 300 nucleotides, preferably of about 20 to about 200 nucleotides, about 20 to about 100 nucleotides, about 20 to about 40 nucleotides, about 20 to about 40 nucleotides, about 24 to about 38 nucleotides, or about 26 to about 38 nucleotides; XZ comprises a nucleic acid sequence that is complementary to a first target nucleic acid sequence; YZ is an oligonucleotide comprising nucleic acid sequence that is complementary to a second target nucleic acid sequence; Z comprises nucleotide sequence of length about 1 to about 24 nucleotides (e.g., about 1, 2, 3, 4, 5, 6, 7, 8, 9, 10, 11, 12, 13, 14, 15, 16, 17, 18, 19, 20, 21, 22, 23, or 24 nucleotides) that is self complimentary; X comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20, or 21 nucleotides) that is complementary to nucleotide sequence present in region Y'; Y comprises nucleotide sequence of length about 1 to about 100 nucleotides, preferably about 1- about 21 nucleotides (e.g., about 1, 2, 3, 4, 5, 6, 7, 8, 9, 10, 11, 12, 13, 14, 15, 16, 17, 18, 19, 20 or 21 nucleotides) that is complementary to nucleotide sequence present in region X'; each p comprises a terminal phosphate group that is independently present or absent; each XZ and YZ is independently of length sufficient to stably interact (i.e., base pair) with the first and second target nucleic acid sequence, respectively, or a portion thereof. For example, each sequence X and Y can independently comprise sequence from about 12 to about 21 or more nucleotides in length (e.g., about 12, 13, 14, 15, 16, 17, 18, 19, 20, 21, or more) that is complementary to a target nucleotide sequence in different target nucleic acid molecules, such as target RNAs or a portion thereof. In another non-limiting example, the length of the nucleotide sequence of X and Z together that is complementary to the first target nucleic acid sequence or a portion thereof is from about 12 to about 21 or more nucleotides (e.g., about 12, 13, 14, 15, 16, 17, 18, 19, 20, 21, or more). In another non-limiting example, the length of the nucleotide sequence of Y and Z together, that is complementary to the second target nucleic acid sequence or a portion thereof is from about 12 to about 21 or more nucleotides (e.g., about 12, 13, 14, 15, 16, 17, 18, 19, 20, 21, or more). In one embodiment, the first target nucleic acid sequence and the second target nucleic acid sequence are present in the same target nucleic acid molecule (e.g., VEGF and/or VEGFR RNA). In another embodiment, the first target nucleic acid sequence and the second target nucleic acid sequence are present in different target nucleic acid molecules (e.g., VEGF, VEGFR, interleukin, and/or interleukin receptor RNA). In one embodiment, Z comprises a palindrome or a repeat sequence. In one embodiment, the lengths of oligonucleotides X and X' are identical. In another embodiment, the lengths of oligonucleotides X and X' are not identical. In one embodiment, the lengths of oligonucleotides Y and Y' are identical. In another embodiment, the lengths of oligonucleotides Y and Y' are not identical. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a multifunctional siNA molecule of the invention comprises a structure having Formula MF-II:

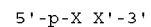

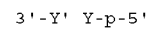

wherein each 5'-p-XX'-3' and 5'-p-YY'-3' are independently an oligonucleotide of length of about 20 nucleotides to about 300 nucleotides, preferably about 20 to about 200 nucleotides, about 20 to about 100 nucleotides, about 20 to about 40 nucleotides, about 20 to about 40 nucleotides, about 24 to about 38 nucleotides, or about 26 to about 38 nucleotides; X comprises a nucleic acid sequence that is complementary to a first target nucleic acid sequence; Y is an oligonucleotide comprising nucleic acid sequence that is complementary to a second target nucleic acid sequence; X comprises a nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20, or 21 nucleotides) that is complementary to nucleotide sequence present in region Y'; Y comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19,20 or 21 nucleotides) that is complementary to nucleotide sequence present in region X'; each p comprises a terminal phosphate group that is independently present or absent; each X and Y independently is of length sufficient to stably interact (i.e., base pair) with the first and second target nucleic acid sequence, respectively, or a portion thereof. For example, each sequence X and Y can independently comprise sequence from about 12 to about 21 or more nucleotides in length (e.g., about 12, 13, 14, 15, 16, 17, 18, 19, 20, 21, or more) that is complementary to a target nucleotide sequence in different target nucleic acid molecules, such as VEGF, VEGFR, interleukin and/or interleukin receptor target RNAs or a portion thereof. In one embodiment, the first target nucleic acid sequence and the second target nucleic acid sequence are present in the same target nucleic acid molecule (e.g., VEGF and/or VEGFR RNA). In another embodiment, the first target nucleic acid sequence and the second target nucleic acid sequence are present in different target nucleic acid molecules (e.g., VEGF, VEGFR, interleukin, and/or interleukin receptor RNA). In one embodiment, Z comprises a palindrome or a repeat sequence. In one embodiment, the lengths of oligonucleotides X and X' are identical. In another embodiment, the lengths of oligonucleotides X and X' are not identical. In one embodiment, the lengths of oligonucleotides Y and Y' are identical. In another embodiment, the lengths of oligonucleotides Y and Y' are not identical. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a multifunctional siNA molecule of the invention comprises a structure having Formula MF-III:

wherein each X, X', Y, and Y' is independently an oligonucleotide of length of about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each X and X' is independently of length sufficient to stably interact (i.e., base pair) with a first and a second target nucleic acid sequence, respectively, or a portion thereof; W represents a nucleotide or non-nucleotide linker that connects sequences Y' and Y; and the multifunctional siNA directs cleavage of the first and second target sequence via RNA interference. In one embodiment, the first target nucleic acid sequence and the second target nucleic acid sequence are present in the same target nucleic acid molecule (e.g., VEGF and/or VEGFR RNA). In another embodiment, the first target nucleic acid sequence and the second target nucleic acid sequence are present in different target nucleic acid molecules (e.g., VEGF, VEGFR, interleukin, and/or interleukin receptor RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, a multifunctional siNA molecule of the invention comprises a structure having Formula MF-IV:

wherein each X, X', Y, and Y' is independently an oligonucleotide of length of about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each Y and Y' is independently of length sufficient to stably interact (i.e., base pair) with a first and a second target nucleic acid sequence, respectively, or a portion thereof; W represents a nucleotide or non-nucleotide linker that connects sequences Y' and Y; and the multifunctional siNA directs cleavage of the first and second target sequence via RNA interference. In one embodiment, the first target nucleic acid sequence and the second target nucleic acid sequence are present in the same target nucleic acid molecule (e.g., VEGF and/or VEGFR RNA). In another embodiment, the first target nucleic acid sequence and the second target nucleic acid sequence are present in different target nucleic acid molecules (e.g., VEGF, VEGFR, interleukin, and/or interleukin receptor RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, a multifunctional siNA molecule of the invention comprises a structure having Formula MF-V:

```
        X    X'

Y'-W-Y
``` wherein each X, X', Y, and Y' is independently an oligonucleotide of length of about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each X, X', Y, or Y' is independently of length sufficient to stably interact (i.e., base pair) with a first, second, third, or fourth target nucleic acid sequence, respectively, or a portion thereof; W represents a nucleotide or non-nucleotide linker that connects sequences Y' and Y; and the multifunctional siNA directs cleavage of the first, second, third, and/or fourth target sequence via RNA interference. In one embodiment, the first, second, third and fourth target nucleic acid sequence are all present in the same target nucleic acid molecule (e.g., VEGF and/or VEGFR RNA). In another embodiment, the first, second, third and fourth target nucleic acid sequence are independently present in different target nucleic acid molecules (e.g., VEGF, VEGFR, interleukin, and/or interleukin receptor RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, regions X and Y of multifunctional siNA molecule of the invention (e.g., having any of Formula MF-I-MF-V), are complementary to different target nucleic acid sequences that are portions of the same target nucleic acid molecule. In one embodiment, such target nucleic acid sequences are at different locations within the coding region of a RNA transcript. In one embodiment, such target nucleic acid sequences comprise coding and non-coding regions of the same RNA transcript. In one embodiment, such target nucleic acid sequences comprise regions of alternately spliced transcripts or precursors of such alternately spliced transcripts.

In one embodiment, a multifunctional siNA molecule having any of Formula MF-I-MF-V can comprise chemical modifications as described herein without limitation, such as, for example, nucleotides having any of Formulae I-VII described herein, stabilization chemistries as described in Table IV, or any other combination of modified nucleotides and non-nucleotides as described in the various embodiments herein.

In one embodiment, the palindrome or repeat sequence or modified nucleotide (e.g., nucleotide with a modified base, such as 2-amino purine or a universal base) in Z of multifunctional siNA constructs having Formula MF-I or MF-II comprises chemically modified nucleotides that are able to interact with a portion of the target nucleic acid sequence (e.g., modified base analogs that can form Watson Crick base pairs or non-Watson Crick base pairs).

In one embodiment, a multifunctional siNA molecule of the invention, for example each strand of a multifunctional siNA having MF-I-MF-V, independently comprises about 15 to about 40 nucleotides (e.g., about 15, 16, 17, 18, 19, 20, 21, 22, 23, 24, 25, 26, 27, 28, 29, 30, 31, 32, 33, 34, 35, 36, 37, 38, 39, or 40 nucleotides). In one embodiment, a multifunctional siNA molecule of the invention comprises one or more chemical modifications. In a non-limiting example, the introduction of chemically modified nucleotides and/or non-nucleotides into nucleic acid molecules of the invention provides a powerful tool in overcoming potential limitations of in vivo stability and bioavailability inherent to unmodified RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum or in cells or tissues. Furthermore, certain chemical modifications can improve the bioavailability and/or potency of nucleic acid molecules by not only enhancing half-life but also facilitating the targeting of nucleic acid molecules to particular organs, cells or tissues and/or improving cellular uptake of the nucleic acid molecules. Therefore, even if the activity of a chemically modified nucleic acid molecule is reduced in vitro as compared to a native/unmodified nucleic acid molecule, for example when compared to an unmodified RNA molecule, the overall activity of the modified nucleic acid molecule can be greater than the native or unmodified nucleic acid molecule due to improved stability, potency, duration of effect, bioavailability and/or delivery of the molecule.

In another embodiment, the invention features multifunctional siNAs, wherein the multifunctional siNAs are assembled from two separate double-stranded siNAs, with one of the ends of each sense strand is tethered to the end of the sense strand of the other siNA molecule, such that the two antisense siNA strands are annealed to their corresponding sense strand that are tethered to each other at one end. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one sense strand of the siNA is tethered to the 5'-end of the sense strand of the other siNA molecule, such that the 5'-ends of the two antisense siNA strands, annealed to their corresponding sense strand that are tethered to each other at one end, point away (in the opposite direction) from each other. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 3'-end of one sense strand of the siNA is tethered to the 3'-end of the sense strand of the other siNA molecule, such that the 5'-ends of the two antisense siNA strands, annealed to their corresponding sense strand that are tethered to each other at one end, face each other. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one sense strand of the siNA is tethered to the 3'-end of the sense strand of the other siNA molecule, such that the 5'-end of the one of the antisense siNA strands annealed to their corresponding sense strand that are tethered to each other at one end, faces the 3'-end of the other antisense strand. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one antisense strand of the siNA is tethered to the 3'-end of the antisense strand of the other siNA molecule, such that the 5'-end of the one of the sense siNA strands annealed to their corresponding antisense sense strand that are tethered to each other at one end, faces the 3'-end of the other sense strand. In one embodiment, the linkage between the 5'-end of the first antisense strand and the 3'-end of the second antisense strand is designed in such a way as to be readily cleavable (e.g., biodegradable linker) such that the 5'end of each antisense strand of the multifunctional siNA has a free 5'-end suitable to mediate RNA intereference-based cleavage of the target RNA. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one antisense strand of the siNA is tethered to the 5'-end of the antisense strand of the other siNA molecule, such that the 3'-end of the one of the sense siNA strands annealed to their corresponding antisense sense strand that are tethered to each other at one end, faces the 3'-end of the other sense strand. In one embodiment, the linkage between the 5'-end of the first antisense strand and the 5'-end of the second antisense strand is designed in such a way as to be readily cleavable (e.g., biodegradable linker) such that the 5'end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 3'-end of one antisense strand of the siNA is tethered to the 3'-end of the antisense strand of the other siNA molecule, such that the 5'-end of the one of the sense siNA strands annealed to their corresponding antisense sense strand that are tethered to each other at one end, faces the 3'-end of the other sense strand. In one embodiment, the linkage between the 5'-end of the first antisense strand and the 5'-end of the second antisense strand is designed in such a way as to be readily cleavable (e.g., biodegradable linker) such that the 5'end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In any of the above embodiments, a first target nucleic acid sequence or second target nucleic acid sequence can independently comprise VEGF, VEGFR, interleukin, and/or interleukin receptor RNA or a portion thereof. In one embodiment, the first target nucleic acid sequence is a VEGF (e.g., any of VEGF-A, VEGF-B, VEGF-C, and/or VEGF-D) RNA or a portion thereof and the second target nucleic acid sequence is a VEGFR (e.g., any of VEGFR1, VEGFR2, and/or VEGFR3) RNA of a portion thereof. In one embodiment, the first target nucleic acid sequence is a VEGFR (e.g., any of VEGFR1, VEGFR2, and/or VEGFR3) RNA or a portion thereof and the second target nucleic acid sequence is a VEGF (e.g., any of VEGF-A, VEGF-B, VEGF-C, and/or VEGF-D) RNA or a portion thereof. In one embodiment, the first target nucleic acid sequence is a VEGF (e.g., any of VEGF-A, VEGF-B, VEGF-C, and/or VEGF-D) RNA or a portion thereof and the second target nucleic acid sequence is a VEGF (e.g., any of VEGF-A, VEGF-B, VEGF-C, and/or VEGF-D) RNA or a portion thereof. In one embodiment, the first target nucleic acid sequence is a VEGFR (e.g., any of VEGFR1, VEGFR2, and/or VEGFR3) RNA or a portion thereof and the second target nucleic acid sequence is a VEGFR (e.g., any of VEGFR1, VEGFR2, and/or VEGFR3) RNA or a portion thereof. In one embodiment, the first target nucleic acid sequence is a VEGF (e.g., any of VEGF-A, VEGF-B, VEGF-C, and/or VEGF-D) RNA or a portion thereof and the second target nucleic acid sequence is a interleukin (e.g., any of IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, and IL-27) RNA or a portion thereof. In one embodiment, the first target nucleic acid sequence is a VEGFR (e.g., any of VEGFR1, VEGFR2, and/or VEGFR3) RNA or a portion thereof and the second target nucleic acid sequence is a interleukin receptor (e.g., any of IL-1R, IL-2R, IL-3R, IL-4R, IL-5R, IL-6R, IL-7R, IL-8R, IL-9R, IL-10R, IL-11R, IL-12R, IL-13R, IL-14R, IL-15R, IL-16R, IL-17R, IL-18R, IL-19R, IL-20R, IL-21R, IL-22R, IL-23R, IL-24R, IL-25R, IL-26R, and IL-27R) RNA or a portion thereof. In one embodiment, the first target nucleic acid sequence is a VEGF (e.g., any of VEGF-A, VEGF-B, VEGF-C, and/or VEGF-D) and VEGFR (e.g., any of VEGFR1, VEGFR2, and/or VEGFR3) RNA or a portion thereof having sequence homology and the second target nucleic acid sequence is a interleukin receptor (e.g., any of IL-1R, IL-2R, IL-3R, IL-4R, IL-5R, IL-6R, IL-7R, IL-8R, IL-9R, IL-10R, IL-11R, IL-12R, IL-13R, IL-14R, IL-15R, IL-16R, IL-17R, IL-18R, IL-19R, IL-20R, IL-21R, IL-22R, IL-23R, IL-24R, IL-25R, IL-26R, and IL-27R)RNA or a portion thereof.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small" refers to nucleic acid motifs no more than 100 nucleotides in length, preferably no more than 80 nucleotides in length, and most preferably no more than 50 nucleotides in length; e.g., individual siNA oligonucleotide sequences or siNA sequences synthesized in tandem) are preferably used for exogenous delivery. The simple structure of these molecules increases the ability of the nucleic acid to invade targeted regions of protein and/or RNA structure. Exemplary molecules of the instant invention are chemically synthesized, and others can similarly be synthesized.

Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.,* 74, 59, Brennan et al., 1998, *Biotechnol Bioeng.,* 61, 33-45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 µmol scale protocol with a 2.5 min coupling step for 2'-O-methylated nucleotides and a 45 second coupling step for 2'-deoxy nucleotides or 2'-deoxy-2'-fluoro nucleotides. Table V outlines the amounts and the contact times of the reagents used in the synthesis cycle. Alternatively, syntheses at the 0.2 µmol scale can be performed on a 96-well plate synthesizer, such as the instrument produced by Protogene (Palo Alto, Calif.) with minimal modification to the cycle. A 33-fold excess (60 µL of 0.11 M=6.6 µmol) of 2'-O-methyl phosphoramidite and a 105-fold excess of S-ethyl tetrazole (60 µL of 0.25 M=15 µmol) can be used in each coupling cycle of 2'-O-methyl residues relative to polymer-bound 5'-hydroxyl. A 22-fold excess (40 µL of 0.11 M=4.4 µmol) of deoxy phosphoramidite and a 70-fold excess of S-ethyl tetrazole (40 µL of 0.25 M=10 µmol) can be used in each coupling cycle of deoxy residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); and oxidation solution is 16.9 mM $I_2$, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide, 0.05 M in acetonitrile) is used.

Deprotection of the DNA-based oligonucleotides is performed as follows: the polymer-bound trityl-on oligoribonucleotide is transferred to a 4 mL glass screw top vial and suspended in a solution of 40% aqueous methylamine (1 mL) at 65° C. for 10 minutes. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder.

The method of synthesis used for RNA including certain siNA molecules of the invention follows the procedure as described in Usman et al., 1987, *J. Am. Chem. Soc.,* 109, 7845; Scaringe et al., 1990, *Nucleic Acids Res.,* 18, 5433; and Wincott et al., 1995, *Nucleic Acids Res.* 23, 2677-2684 Wincott et al., 1997, *Methods Mol. Bio.,* 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 µmol scale protocol with a 7.5 min coupling step for alkylsilyl protected nucleotides and a 2.5 min coupling step for 2'-O-methylated nucleotides. Table V outlines the amounts and the contact times of the reagents used in the synthesis cycle. Alternatively, syntheses at the 0.2 µmol scale can be done on a 96-well plate synthesizer, such as the instrument produced by Protogene (Palo Alto, Calif.) with minimal modification to the cycle. A 33-fold excess (60 µL of 0.11 M=6.6 µmol) of 2'-O-methyl phosphoramidite and a 75-fold excess of S-ethyl tetrazole (60 µL of 0.25 M=15 µmol) can be used in each coupling cycle of 2'-O-methyl residues relative to polymer-bound 5'-hydroxyl. A 66-fold excess (120 µL of 0.11 M=13.2 µmol) of alkylsilyl (ribo) protected phosphoramidite and a 150-fold excess of S-ethyl tetrazole (120 µL of 0.25 M=30 µmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied. Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); oxidation solution is 16.9 mM $I_2$, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide 0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH: MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 µL of a solution of 1.5 mL N-methylpyrrolidinone, 750 µL TEA and 1 mL TEA.3HF to provide a 1.4 M HF concentration) and heated to 65° C. After 1.5 h, the oligomer is quenched with 1.5 M $NH_4HCO_3$.

Alternatively, for the one-pot protocol, the polymer-bound trityl-on oligoribonucleotide is transferred to a 4 mL glass screw top vial and suspended in a solution of 33% ethanolic methylamine/DMSO: 1/1 (0.8 mL) at 65° C. for 15 minutes. The vial is brought to room temperature TEA.3HF (0.1 mL) is added and the vial is heated at 65° C. for 15 minutes. The sample is cooled at −20° C. and then quenched with 1.5 M $NH_4HCO_3$.

For purification of the trityl-on oligomers, the quenched $NH_4HCO_3$ solution is loaded onto a C-18 containing cartridge that had been prewashed with acetonitrile followed by 50 mM TEAA. After washing the loaded cartridge with water, the RNA is detritylated with 0.5% TFA for 13 minutes. The cartridge is then washed again with water, salt exchanged with 1 M NaCl and washed with water again. The oligonucleotide is then eluted with 30% acetonitrile.

The average stepwise coupling yields are typically >98% (Wincott et al., 1995 *Nucleic Acids Res.* 23, 2677-2684). Those of ordinary skill in the art will recognize that the scale of synthesis can be adapted to be larger or smaller than the example described above including but not limited to 96-well format.

Alternatively, the nucleic acid molecules of the present invention can be synthesized separately and joined together post-synthetically, for example, by ligation (Moore et al., 1992, *Science* 256, 9923; Draper et al., International PCT publication No. WO 93/23569; Shabarova et al., 1991, *Nucleic Acids Research* 19, 4247; Bellon et al., 1997, *Nucleosides & Nucleotides*, 16, 951; Bellon et al., 1997, *Bioconjugate Chem.* 8, 204), or by hybridization following synthesis and/or deprotection.

The siNA molecules of the invention can also be synthesized via a tandem synthesis methodology as described in Example 1 herein, wherein both siNA strands are synthesized as a single contiguous oligonucleotide fragment or strand separated by a cleavable linker which is subsequently cleaved to provide separate siNA fragments or strands that hybridize and permit purification of the siNA duplex. The linker can be a polynucleotide linker or a non-nucleotide linker. The tandem synthesis of siNA as described herein can be readily adapted to both multiwell/multiplate synthesis platforms such as 96 well or similarly larger multi-well platforms. The tandem synthesis of siNA as described herein can also be readily adapted to large scale synthesis platforms employing batch reactors, synthesis columns and the like.

A siNA molecule can also be assembled from two distinct nucleic acid strands or fragments wherein one fragment includes the sense region and the second fragment includes the antisense region of the RNA molecule.

The nucleic acid molecules of the present invention can be modified extensively to enhance stability by modification with nuclease resistant groups, for example, 2'-amino, 2'-C-allyl, 2'-fluoro, 2'-O-methyl, 2'-H (for a review see Usman and Cedergren, 1992, *TIBS* 17, 34; Usman et al., 1994, *Nucleic Acids Symp. Ser.* 31, 163). siNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, siNA molecules of the invention are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules.

Optimizing Activity of the Nucleic Acid Molecule of the Invention.

Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., 1990 *Nature* 344, 565; Pieken et al., 1991, *Science* 253, 314; Usman and Cedergren, 1992, *Trends in Biochem. Sci.* 17, 334; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, 1992, *TIBS.* 17, 34; Usman et al., 1994, *Nucleic Acids Symp. Ser.* 31, 163; Burgin et al., 1996, *Biochemistry*, 35, 14090). Sugar modification of nucleic acid molecules have been extensively described in the art (see Eckstein et al., International Publication PCT No. WO 92/07065; Perrault et al. *Nature*, 1990, 344, 565-568; Pieken et al. *Science*, 1991, 253, 314-317; Usman and Cedergren, *Trends in Biochem. Sci.*, 1992, 17, 334-339; Usman et al. International Publication PCT No. WO 93/15187; Sproat, U.S. Pat. No. 5,334,711 and Beigelman et al., 1995, *J. Biol. Chem.*, 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.*, 39, 1131; Earnshaw and Gait, 1998, *Biopolymers (Nucleic Acid Sciences)*, 48, 39-55; Verma and Eckstein, 1998, *Annu. Rev. Biochem.*, 67, 99-134; and Burlina et al., 1997, *Bioorg. Med. Chem.*, 5, 1999-2010; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the siNA nucleic acid molecules of the instant invention so long as the ability of siNA to promote RNAi is cells is not significantly inhibited.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

Short interfering nucleic acid (siNA) molecules having chemical modifications that maintain or enhance activity are provided. Such a nucleic acid is also generally more resistant to nucleases than an unmodified nucleic acid. Accordingly, the in vitro and/or in vivo activity should not be significantly lowered. In cases in which modulation is the goal, therapeutic nucleic acid molecules delivered exogenously should optimally be stable within cells until translation of the target RNA has been modulated long enough to reduce the levels of the undesirable protein. This period of time varies between hours to days depending upon the disease state. Improvements in the chemical synthesis of RNA and DNA (Wincott et al., 1995, *Nucleic Acids Res.* 23, 2677; Caruthers et al., 1992, *Methods in Enzymology* 211, 3-19 (incorporated by reference herein)) have expanded the ability to modify nucleic acid molecules by introducing nucleotide modifications to enhance their nuclease stability, as described above.

In one embodiment, nucleic acid molecules of the invention include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.*, 120, 8531-8532. A single G-clamp analog substitution within an oligonucleotide can result in substantially enhanced helical thermal stability and mismatch discrimination when hybridized to complementary oligonucleotides. The inclusion of such nucleotides in nucleic acid molecules of the invention results in both enhanced affinity and specificity to nucleic acid targets, complementary sequences, or template strands. In another embodiment, nucleic acid molecules of the invention include one or more (e.g., about 1, 2, 3, 4, 5, 6, 7, 8, 9, 10, or more) LNA "locked nucleic acid" nucleotides such as a 2',4'-C methylene bicyclo nucleotide (see for example Wengel et al., International PCT Publication No. WO 00/66604 and WO 99/14226).

In another embodiment, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, cholesterol, phospholipids, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

The term "biodegradable linker" as used herein, refers to a nucleic acid or non-nucleic acid linker molecule that is designed as a biodegradable linker to connect one molecule to another molecule, for example, a biologically active molecule to a siNA molecule of the invention or the sense and antisense strands of a siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically-modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The term "biodegradable" as used herein, refers to degradation in a biological system, for example, enzymatic degradation or chemical degradation.

The term "biologically active molecule" as used herein refers to compounds or molecules that are capable of eliciting or modifying a biological response in a system. Non-limiting examples of biologically active siNA molecules either alone or in combination with other molecules contemplated by the instant invention include therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, 2,5-A chimeras, siNA, dsRNA, allozymes, aptamers, decoys and analogs thereof. Biologically active molecules of the invention also include molecules capable of modulating the pharmacokinetics and/or pharmacodynamics of other biologically active molecules, for example, lipids and polymers such as polyamines, polyamides, polyethylene glycol and other polyethers.

The term "phospholipid" as used herein, refers to a hydrophobic molecule comprising at least one phosphorus group. For example, a phospholipid can comprise a phosphorus-containing group and saturated or unsaturated alkyl group, optionally substituted with OH, COOH, oxo, amine, or substituted or unsubstituted aryl groups.

Therapeutic nucleic acid molecules (e.g., siNA molecules) delivered exogenously optimally are stable within cells until reverse transcription of the RNA has been modulated long enough to reduce the levels of the RNA transcript. The nucleic acid molecules are resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In yet another embodiment, siNA molecules having chemical modifications that maintain or enhance enzymatic activity of proteins involved in RNAi are provided. Such nucleic acids are also generally more resistant to nucleases than unmodified nucleic acids. Thus, in vitro and/or in vivo the activity should not be significantly lowered.

Use of the nucleic acid-based molecules of the invention will lead to better treatments by affording the possibility of combination therapies (e.g., multiple siNA molecules targeted to different genes; nucleic acid molecules coupled with known small molecule modulators; or intermittent treatment with combinations of molecules, including different motifs and/or other chemical or biological molecules). The treatment of subjects with siNA molecules can also include combinations of different types of nucleic acid molecules, such as enzymatic nucleic acid molecules (ribozymes), allozymes, antisense, 2,5-A oligoadenylate, decoys, and aptamers.

In another aspect a siNA molecule of the invention comprises one or more 5' and/or a 3'-cap structure, for example, on only the sense siNA strand, the antisense siNA strand, or both siNA strands.

By "cap structure" is meant chemical modifications, which have been incorporated at either terminus of the oligonucleotide (see, for example, Adamic et al., U.S. Pat. No. 5,998, 203, incorporated by reference herein). These terminal modifications protect the nucleic acid molecule from exonuclease degradation, and may help in delivery and/or localization within a cell. The cap may be present at the 5'-terminus (5'-cap) or at the 3'-terminal (3'-cap) or may be present on both termini. In non-limiting examples, the 5'-cap includes, but is not limited to, glyceryl, inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. Non-limiting examples of cap moieties are shown in FIG. 10.

Non-limiting examples of the 3'-cap include, but are not limited to, glyceryl, inverted deoxy abasic residue (moiety), 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine and therefore lacks a base at the 1'-position.

An "alkyl" group refers to a saturated aliphatic hydrocarbon, including straight-chain, branched-chain, and cyclic alkyl groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted the substituted group(s) is preferably, hydroxyl, cyano, alkoxy, =O, =S, $NO_2$ or $N(CH_3)_2$, amino, or SH. The term also includes alkenyl groups that are unsaturated hydrocarbon groups containing at least one carbon-carbon double bond, including straight-chain, branched-chain, and cyclic groups. Preferably, the alkenyl group has 1 to 12 carbons. More preferably, it is a lower alkenyl of from 1 to 7 carbons, more preferably 1 to 4 carbons. The alkenyl group may be substituted or unsubstituted. When substituted the substituted group(s) is preferably, hydroxyl, cyano, alkoxy, =O, =S, $NO_2$, halogen, $N(CH_3)_2$, amino, or SH. The term "alkyl" also includes alkynyl groups that have an unsaturated hydrocarbon group containing at least one carbon-carbon triple bond, including straight-chain, branched-chain, and cyclic groups. Preferably, the alkynyl group has 1 to 12 carbons. More preferably, it is a lower alkynyl of from 1 to 7 carbons, more preferably 1 to 4 carbons. The alkynyl group may be substituted or unsubstituted. When substituted the substituted group(s) is preferably, hydroxyl, cyano, alkoxy, =O, =S, $NO_2$ or $N(CH_3)_2$, amino or SH.

Such alkyl groups can also include aryl, alkylaryl, carbocyclic aryl, heterocyclic aryl, amide and ester groups. An "aryl" group refers to an aromatic group that has at least one ring having a conjugated pi electron system and includes carbocyclic aryl, heterocyclic aryl and biaryl groups, all of which may be optionally substituted. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

By "nucleotide" as used herein is as recognized in the art to include natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, for example, Usman and McSwiggen, supra; Eckstein et al., International PCT Publication No. WO 92/07065; Usman et al., International PCT Publication No. WO 93/15187; Uhlman & Peyman, supra, all are hereby incorporated by reference herein). There are several examples of modified nucleic acid bases known in the art as summarized by Limbach et al., 1994, *Nucleic Acids Res.* 22, 2183. Some of the non-limiting examples of base modifications that can be introduced into nucleic acid molecules include, inosine, purine, pyridin-4-one, pyridin-2-one, phenyl, pseudouracil, 2, 4, 6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin et al., 1996, *Biochemistry*, 35, 14090; Uhlman & Peyman, supra). By "modified bases" in this aspect is meant nucleotide bases other than adenine, guanine, cytosine and uracil at 1' position or their equivalents.

In one embodiment, the invention features modified siNA molecules, with phosphate backbone modifications comprising one or more phosphorothioate, phosphorodithioate, methylphosphonate, phosphotriester, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications, see Hunziker and Leumann, 1995, *Nucleic Acid Analogues: Synthesis and Properties*, in *Modern Synthetic Methods*, VCH, 331-417, and Mesmaeker et al., 1994, *Novel Backbone Replacements for Oligonucleotides*, in *Carbohydrate Modifications in Antisense Research*, ACS, 24-39.

By "abasic" is meant sugar moieties lacking a nucleobase or having a hydrogen atom (H) or other non-nucleobase chemical groups in place of a nucleobase at the 1' position of the sugar moiety, see for example Adamic et al., U.S. Pat. No. 5,998,203. In one embodiment, an abasic moiety of the invention is a ribose, deoxyribose, or dideoxyribose sugar.

By "unmodified nucleoside" is meant one of the bases adenine, cytosine, guanine, thymine, or uracil joined to the 1' carbon of β-D-ribo-furanose.

By "modified nucleoside" is meant any nucleotide base which contains a modification in the chemical structure of an unmodified nucleotide base, sugar and/or phosphate. Non-limiting examples of modified nucleotides are shown by Formulae I-VII and/or other modifications described herein.

In connection with 2'-modified nucleotides as described for the present invention, by "amino" is meant 2'-$NH_2$ or 2'-O—$NH_2$, which can be modified or unmodified. Such modified groups are described, for example, in Eckstein et al., U.S. Pat. No. 5,672,695 and Matulic-Adamic et al., U.S. Pat. No. 6,248,878, which are both incorporated by reference in their entireties.

Various modifications to nucleic acid siNA structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

Administration of Nucleic Acid Molecules

A siNA molecule of the invention can be adapted for use to treat, prevent, inhibit, or reduce cancer, ocular, proliferative, respiratory, autoimmune, neurologic, allergic, or angiogenesis/neovascularization related diseases, conditions, or disorders, and/or any other trait, disease or condition that is related to or will respond to the levels of VEGF, VEGFR, interleukin, and/or interleukin receptor in a cell or tissue, alone or in combination with other therapies.

In one embodiment, a siNA composition of the invention can comprise a delivery vehicle, including liposomes, for administration to a subject, carriers and diluents and their salts, and/or can be present in pharmaceutically acceptable formulations. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192, all of which are incorporated herein by reference. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example Gonzalez et al., 1999, *Bioconjugate Chem.*, 10, 1068-1074; Wang et al., International PCT publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722). In another embodiment, the nucleic acid molecules of the invention can also be formulated or complexed with polyethyleneimine and derivatives thereof, such as polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives. In one embodiment, the nucleic acid molecules of the invention are formulated as described in United States Patent Application Publication No. 20030077829, incorporated by reference herein in its entirety.

In one embodiment, a siNA molecule of the invention is formulated as a composition described in U.S. Provisional patent application No. 60/678,531 and in related U.S. Provisional patent application No. 60/703,946, filed Jul. 29, 2005, and U.S. Provisional patent application No. 60/737,024, filed Nov. 15, 2005 (Vargeese et al.), all of which are incorporated by reference herein in their entirety. Such siNA formulations are generally referred to as "lipid nucleic acid particles" (LNP).

In one embodiment, a siNA molecule of the invention is complexed with membrane disruptive agents such as those described in U.S. Patent Application Publication No. 20010007666, incorporated by reference herein in its entirety including the drawings. In another embodiment, the membrane disruptive agent or agents and the siNA molecule are also complexed with a cationic lipid or helper lipid molecule, such as those lipids described in U.S. Pat. No. 6,235,310, incorporated by reference herein in its entirety including the drawings.

In one embodiment, a siNA molecule of the invention is complexed with delivery systems as described in U.S. Patent Application Publication No. 2003077829 and International PCT Publication Nos. WO 00/03683 and WO 02/087541, all incorporated by reference herein in their entirety including the drawings.

In one embodiment, a compound, molecule, or composition for the treatment of ocular conditions (e.g., macular degeneration, diabetic retinopathy etc.) is administered to a subject intraocularly or by intraocular means. In another embodiment, a compound, molecule, or composition for the treatment of ocular conditions (e.g., macular degeneration, diabetic retinopathy etc.) is administered to a subject periocularly or by periocular means (see for example Ahlheim et al., International PCT publication No. WO 03/24420). In one embodiment, a siNA molecule and/or formulation or composition thereof is administered to a subject intraocularly or by intraocular means. In another embodiment, a siNA molecule and/or formulation or composition thereof is administered to a subject periocularly or by periocular means. Periocular administration generally provides a less invasive approach to administering siNA molecules and formulation or composition thereof to a subject (see for example Ahlheim et al., International PCT publication No. WO 03/24420). The use of periocular administration also minimizes the risk of retinal detachment, allows for more frequent dosing or administration, provides a clinically relevant route of administration for macular degeneration and other optic conditions, and also provides the possibility of using reservoirs (e.g., implants, pumps or other devices) for drug delivery. In one embodiment, siNA compounds and compositions of the invention are administered locally, e.g., via intraocular or periocular means, such as injection, iontophoresis (see, for example, WO 03/043689 and WO 03/030989), or implant, about every 1-50 weeks (e.g., about every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 weeks), alone or in combination with other compounds and/or therapies herein. In one embodiment, siNA compounds and compositions of the invention are administered systemically (e.g., via intravenous, subcutaneous, intramuscular, infusion, pump, implant etc.) about every 1-50 weeks (e.g., about every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 weeks), alone or in combination with other compounds and/or therapies described herein and/or otherwise known in the art.

In one embodiment, the nucleic acid molecules of the invention are administered to skeletal tissues (e.g., bone, cartilage, tendon, ligament) or bone metastatic tumors via atelocollagen complexation or conjugation (see for example Takeshita et al., 2005, PNAS, 102, 12177-12182). Therefore, in one embodiment, the instant invention features one or more dsiNA molecules as a composition complexed with atelocollagen. In another embodiment, the instant invention features one or more siNA molecules conjugated to atelocollagen via a linker as described herein or otherwise known in the art.

In one embodiment, the nucleic acid molecules of the invention are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles comprising a nucleic acid composition of the invention can be produced by any suitable means, such as with a nebulizer (see for example U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers comprise the active ingredient in a liquid carrier in an amount of up to 40% w/w preferably less than 20% w/w of the formulation. The carrier is typically water or a dilute aqueous alcoholic solution, preferably made isotonic with body fluids by the addition of, for example, sodium chloride or other suitable salts. Optional additives include preservatives if the formulation is not prepared sterile, for example, methyl hydroxybenzoate, anti-oxidants, flavorings, volatile oils, buffering agents and emulsifiers and other formulation surfactants. The aerosols of solid particles comprising the active composition and surfactant can likewise be produced with any solid particulate aerosol generator. Aerosol generators for administering solid particulate therapeutics to a subject produce particles which are respirable, as explained above, and generate a volume of aerosol containing a predetermined metered dose of a therapeutic composition at a rate suitable for human administration.

In one embodiment, a solid particulate aerosol generator of the invention is an insufflator. Suitable formulations for administration by insufflation include finely comminuted powders which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically comprises from 0.1 to 100 w/w of the formulation. A second type of illustrative aerosol generator comprises a metered dose inhaler. Metered dose inhalers are pressurized aerosol dispensers, typically containing a suspension or solution formulation of the active ingredient in a liquefied propellant. During use these devices discharge the formulation through a valve adapted to deliver a metered volume to produce a fine particle spray containing the active ingredient. Suitable propellants include certain chlorofluorocarbon compounds, for example, dichlorodifluoromethane, trichlorofluoromethane, dichlorotetrafluoroethane and mixtures thereof. The formulation can additionally contain one or more co-solvents, for example, ethanol, emulsifiers and other formulation surfactants, such as oleic acid or sorbitan trioleate, anti-oxidants and suitable flavoring agents. Other methods for pulmonary delivery are described in, for example US Patent Application No. 20040037780, and U.S. Pat. Nos. 6,592,904; 6,582,728; 6,565,885, all incorporated by reference herein.

In one embodiment, the invention features the use of methods to deliver the nucleic acid molecules of the instant invention to the central nervous system and/or peripheral nervous system. Experiments have demonstrated the efficient in vivo uptake of nucleic acids by neurons. As an example of local administration of nucleic acids to nerve cells, Sommer et al., 1998, *Antisense Nuc. Acid Drug Dev.*, 8, 75, describe a study in which a 15 mer phosphorothioate antisense nucleic acid molecule to c-fos is administered to rats via microinjection into the brain. Antisense molecules labeled with tetramethylrhodamine-isothiocyanate (TRITC) or fluorescein isothiocyanate (FITC) were taken up by exclusively by neurons thirty minutes post-injection. A diffuse cytoplasmic staining and nuclear staining was observed in these cells. As an example of systemic administration of nucleic acid to nerve cells, Epa et al., 2000, *Antisense Nuc. Acid Drug Dev.*, 10, 469, describe an in vivo mouse study in which beta-cyclodextrin-adamantane-oligonucleotide conjugates were used to target the p75 neurotrophin receptor in neuronally differentiated PC12 cells. Following a two week course of IP administration, pronounced uptake of p75 neurotrophin receptor antisense was observed in dorsal root ganglion (DRG) cells. In addition, a marked and consistent down-regulation of p75 was observed in DRG neurons. Additional approaches to the targeting of nucleic acid to neurons are described in Broaddus et al., 1998, *J. Neurosurg.*, 88(4), 734; Karle et al., 1997, *Eur. J. Pharmocol.*, 340(2/3), 153; Bannai et al., 1998, *Brain Research*, 784 (1,2), 304; Rajakumar et al., 1997, *Synapse*, 26(3), 199; Wupong et al., 1999, *BioPharm*, 12(1), 32; Bannai et al., 1998, *Brain Res. Protoc.*, 3(1), 83; Simantov et al., 1996, *Neuroscience*, 74(1), 39. Nucleic acid molecules of the invention are therefore amenable to delivery to and uptake by cells that express repeat expansion allelic variants for modulation of RE gene expression. The delivery of nucleic acid molecules of the invention, targeting RE is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

The delivery of nucleic acid molecules of the invention to the CNS is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

In one embodiment, a siNA molecule of the invention is administered iontophoretically, for example to a particular organ or compartment (e.g., the eye, back of the eye, heart, liver, kidney, bladder, prostate, tumor, CNS etc.). Non-limiting examples of iontophoretic delivery are described in, for example, WO 03/043689 and WO 03/030989, which are incorporated by reference in their entireties herein.

In one embodiment, the siNA molecules of the invention and formulations or compositions thereof are administered to the liver as is generally known in the art (see for example Wen et al., 2004, *World J Gastroenterol.*, 10, 244-9; Murao et al., 2002, *Pharm Res.*, 19, 1808-14; Liu et al., 2003, *Gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *Gene Ther.*, 10, 1559-66).

In one embodiment, the invention features the use of methods to deliver the nucleic acid molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood*, 91(3), 852-862; Filion and Phillips, 1997, *Biochim. Biophys. Acta.*, 1329(2), 345-356; Ma and Wei, 1996, *Leuk Res.*, 20(11/12), 925-930; and Bongartz et al., 1994, *Nucleic Acids Research*, 22(22), 4681-8. Such methods, as described above, include the use of free oligonucleitide, cationic lipid formulations, liposome formulations including pH sensitive liposomes and immunoliposomes, and bioconjugates including oligonucleotides conjugated to fusogenic peptides, for the transfection of hematopoietic cells with oligonucleotides.

In one embodiment, the siNA molecules and compositions of the invention are administered to the inner ear by contacting the siNA with inner ear cells, tissues, or structures such as the cochlea, under conditions suitable for the administration. In one embodiment, the administration comprises methods and devices as described in U.S. Pat. Nos. 5,421,818, 5,476, 446, 5,474,529, 6,045,528, 6,440,102, 6,685,697, 6,120,484; and 5,572,594; all incorporated by reference herein and the teachings of Silverstein, 1999, Ear Nose Throat J., 78, 595-8, 600; and Jackson and Silverstein, 2002, Otolaryngol Clin North Am., 35, 639-53, and adapted for use the siNA molecules of the invention.

In one embodiment, the siNA molecules of the invention and formulations or compositions thereof are administered directly or topically (e.g., locally) to the dermis or follicles as is generally known in the art (see for example Brand, 2001, *Curr. Opin. Mol. Ther.*, 3, 244-8; Regnier et al., 1998, *J. Drug Target*, 5, 275-89; Kanikkannan, 2002, *BioDrugs*, 16, 339-47; Wraight et al., 2001, *Pharmacol. Ther.*, 90, 89-104; and Preat and Dujardin, 2001, STP PharmaSciences, 11, 57-68). In one embodiment, the siNA molecules of the invention and formulations or compositions thereof are administered directly or topically using a hydroalcoholic gel formulation comprising an alcohol (e.g., ethanol or isopropanol), water, and optionally including additional agents such isopropyl myristate and carbomer 980.

In one embodiment, delivery systems of the invention include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrolidone). In one embodiment, the pharmaceutically acceptable carrier is a liposome or a transdermal enhancer. Examples of liposomes which can be used in this invention include the following: (1) CellFectin, 1:1.5 (M/M) liposome formulation of the cationic lipid N,NI,NII,NIII-tetramethyl-N,NI,NII,NIII-tetrapalmity-spermine and dioleoyl phosphatidylethanolamine (DOPE) (GIBCO BRL); (2) Cytofectin GSV, 2:1 (M/M) liposome formulation of a cationic lipid and DOPE (Glen Research); (3) DOTAP (N-[1-(2,3-dioleoyloxy)-N,N,N-tri-methyl-ammoniummethylsulfate) (Boehringer Manheim); and (4) Lipofectamine, 3:1 (M/M) liposome formulation of the polycationic lipid DOSPA and the neutral lipid DOPE (GIBCO BRL).

In one embodiment, delivery systems of the invention include patches, tablets, suppositories, pessaries, gels and creams, and can contain excipients such as solubilizers and enhancers (e.g., propylene glycol, bile salts and amino acids), and other vehicles (e.g., polyethylene glycol, fatty acid esters and derivatives, and hydrophilic polymers such as hydroxypropylmethylcellulose and hyaluronic acid).

In one embodiment, a siNA molecule of the invention is administered iontophoretically, for example to the dermis or to other relevant tissues such as the inner ear/cochlea. Non-limiting examples of iontophoretic delivery are described in, for example, WO 03/043689 and WO 03/030989, which are incorporated by reference in their entireties herein.

In one embodiment, siNA molecules of the invention are formulated or complexed with polyethylenimine (e.g., linear or branched PEI) and/or polyethylenimine derivatives, including for example grafted PEIs such as galactose PEI, cholesterol PEI, antibody derivatized PEI, and polyethylene glycol PEI (PEG-PEI) derivatives thereof (see for example Ogris et al., 2001, *AAPA PharmSci*, 3, 1-11; Furgeson et al., 2003, Bioconjugate Chem., 14, 840-847; Kunath et al., 2002, Phramaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999., PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; and Sagara, U.S. Pat. No. 6,586,524, incorporated by reference herein.

In one embodiment, a siNA molecule of the invention comprises a bioconjugate, for example a nucleic acid conjugate as described in Vargeese et al., U.S. Ser. No. 10/427,160, filed Apr. 30, 2003; U.S. Pat. Nos. 6,528,631; 6,335,434; 6,235,886; 6,153,737; 5,214,136; 5,138,045, all incorporated by reference herein.

Thus, the invention features a pharmaceutical composition comprising one or more nucleic acid(s) of the invention in an acceptable carrier, such as a stabilizer, buffer, and the like. The polynucleotides of the invention can be administered (e.g., RNA, DNA or protein) and introduced to a subject by any standard means, with or without stabilizers, buffers, and the like, to form a pharmaceutical composition. When it is desired to use a liposome delivery mechanism, standard protocols for formation of liposomes can be followed. The compositions of the present invention can also be formulated and used as creams, gels, sprays, oils and other suitable compositions for topical, dermal, or transdermal administration as is known in the art.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic or local administration, into a cell or subject, including for example a human. Suitable forms, in part, depend upon the use or the route of entry, for example oral, transdermal, or by injection. Such forms should not prevent the composition or formulation from reaching a target cell (i.e., a cell to which the negatively charged nucleic acid is desirable for delivery). For example, pharmacological compositions injected into the blood stream should be soluble. Other factors are known in the art, and include considerations such as toxicity and forms that prevent the composition or formulation from exerting its effect.

In one embodiment, siNA molecules of the invention are administered to a subject by systemic administration in a pharmaceutically acceptable composition or formulation. By "systemic administration" is meant in vivo systemic absorption or accumulation of drugs in the blood stream followed by distribution throughout the entire body. Administration routes that lead to systemic absorption include, without limitation: intravenous, subcutaneous, portal vein, intraperitoneal, inhalation, oral, intrapulmonary and intramuscular. Each of these administration routes exposes the siNA molecules of the invention to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation that can facilitate the association of drug with the surface of cells, such as, lymphocytes and macrophages is also useful. This approach can provide enhanced delivery of the drug to target cells by taking advantage of the specificity of macrophage and lymphocyte immune recognition of abnormal cells.

By "pharmaceutically acceptable formulation" or "pharmaceutically acceptable composition" is meant, a composition or formulation that allows for the effective distribution of the nucleic acid molecules of the instant invention in the physical location most suitable for their desired activity. Non-limiting examples of agents suitable for formulation with the nucleic acid molecules of the instant invention include: P-glycoprotein inhibitors (such as Pluronic P85); biodegradable polymers, such as poly (DL-lactide-coglycolide) microspheres for sustained release delivery (Emerich, D F et al, 1999, *Cell Transplant*, 8, 47-58); and loaded nanoparticles, such as those made of polybutylcyanoacrylate. Other non-limiting examples of delivery strategies for the nucleic acid molecules of the instant invention include material described in Boado et al., 1998, *J. Pharm. Sci.*, 87, 1308-1315; Tyler et al., 1999, *FEBS Lett.*, 421, 280-284; Pardridge et al., 1995, *PNAS USA.*, 92, 5592-5596; Boado, 1995, *Adv. Drug Delivery Rev.*, 15, 73-107; Aldrian-Herrada et al., 1998, *Nucleic Acids Res.*, 26, 4910-4916; and Tyler et al., 1999, *PNAS USA.*, 96, 7053-7058.

The invention also features the use of a composition comprising surface-modified liposomes containing poly (ethylene glycol) lipids (PEG-modified, or long-circulating liposomes or stealth liposomes) and nucleic acid molecules of the invention. These formulations offer a method for increasing the accumulation of drugs (e.g., siNA) in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601-2627; Ishiwata et al., *Chem. Pharm. Bull.* 1995, 43, 1005-1011). Such liposomes have been shown to accumulate selectively in tumors, presumably by extravasation and capture in the neovascularized target tissues (Lasic et al., *Science* 1995, 267, 1275-1276; Oku et al., 1995, *Biochim. Biophys. Acta*, 1238, 86-90). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864-24870; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

The present invention also includes compositions prepared for storage or administration that include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors that those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray, or rectally in dosage unit formulations containing conventional non-toxic pharmaceutically acceptable carriers, adjuvants, and/or vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono-or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

In one embodiment, the invention comprises compositions suitable for administering nucleic acid molecules of the invention to specific cell types. For example, the asialoglycoprotein receptor (ASGPr) (Wu and Wu, 1987, *J. Biol. Chem.* 262, 4429-4432) is unique to hepatocytes and binds branched galactose-terminal glycoproteins, such as asialoorosomucoid (ASOR). In another example, the folate receptor is overexpressed in many cancer cells. Binding of such glycoproteins, synthetic glycoconjugates, or folates to the receptor takes place with an affinity that strongly depends on the degree of branching of the oligosaccharide chain, for example, triatennary structures are bound with greater affinity than biatenarry or monoatennary chains (Baenziger and Fiete, 1980, *Cell*, 22, 611-620; Connolly et al., 1982, *J. Biol. Chem.*, 257, 939-945). Lee and Lee, 1987, *Glycoconjugate J.*, 4, 317-328, obtained this high specificity through the use of N-acetyl-D-galactosamine as the carbohydrate moiety, which has higher affinity for the receptor, compared to galactose. This "clustering effect" has also been described for the binding and uptake of mannosyl-terminating glycoproteins or glycoconjugates (Ponpipom et al., 1981, *J. Med. Chem.*, 24, 1388-1395). The use of galactose, galactosamine, or folate based conjugates to transport exogenous compounds across cell membranes can provide a targeted delivery approach to, for example, the treatment of liver disease, cancers of the liver, or other cancers. The use of bioconjugates can also provide a reduction in the required dose of therapeutic compounds required for treatment. Furthermore, therapeutic bioavailability, pharmacodynamics, and pharmacokinetic parameters can be modulated through the use of nucleic acid bioconjugates of the invention. Non-limiting examples of such bioconjugates are described in Vargeese et al., U.S. Ser. No. 10/201,394, filed Aug. 13, 2001; and Matulic-Adamic et al., U.S. Ser. No. 60/362,016, filed Mar. 6, 2002.

Alternatively, certain siNA molecules of the instant invention can be expressed within cells from eukaryotic promoters (e.g., Izant and Weintraub, 1985, *Science*, 229, 345; McGarry and Lindquist, 1986, *Proc. Natl. Acad. Sci.*, USA 83, 399; Scanlon et al., 1991, *Proc. Natl. Acad. Sci. USA*, 88, 10591-5; Kashani-Sabet et al., 1992, *Antisense Res. Dev.*, 2, 3-15; Dropulic et al., 1992, *J. Virol.*, 66, 1432-41; Weerasinghe et al., 1991, *J. Virol.*, 65, 5531-4; Ojwang et al., 1992, *Proc. Natl. Acad. Sci. USA*, 89, 10802-6; Chen et al., 1992, *Nucleic Acids Res.*, 20, 4581-9; Sarver et al., 1990 *Science*, 247, 1222-1225; Thompson et al., 1995, *Nucleic Acids Res.*, 23, 2259; Good et al., 1997, *Gene Therapy*, 4, 45. Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, *Nucleic Acids Symp. Ser.*, 27, 15-6; Taira et al., 1991, *Nucleic Acids Res.*, 19, 5125-30; Ventura et al., 1993, *Nucleic Acids Res.*, 21, 3249-55; Chowrira et al., 1994, *J. Biol. Chem.*, 269, 25856.

In another aspect of the invention, RNA molecules of the present invention can be expressed from transcription units (see for example Couture et al., 1996, *TIG.*, 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. In another embodiment, pol III based constructs are used to express nucleic acid molecules of the invention (see for example Thompson, U.S. Pats. Nos. 5,902,880 and 6,146,886). The recombinant vectors capable of expressing the siNA molecules can be delivered as described above, and persist in target cells. Alternatively, viral vectors can be used that provide for transient expression of nucleic acid molecules. Such vectors can be repeatedly administered as necessary. Once expressed, the siNA molecule interacts with the target mRNA and generates an RNAi response. Delivery of siNA molecule expressing vectors can be systemic, such as by intravenous or intramuscular administration, by administration to target cells ex-planted from a subject followed by reintroduction into the subject, or by any other means that would allow for introduction into the desired target cell (for a review see Couture et al., 1996, *TIG.*, 12, 510).

In one aspect the invention features an expression vector comprising a nucleic acid sequence encoding at least one siNA molecule of the instant invention. The expression vector can encode one or both strands of a siNA duplex, or a single self-complementary strand that self hybridizes into a siNA duplex. The nucleic acid sequences encoding the siNA molecules of the instant invention can be operably linked in a manner that allows expression of the siNA molecule (see for example Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, *Nature Medicine*, advance online publication doi:10.1038/nm725).

In another aspect, the invention features an expression vector comprising: a) a transcription initiation region (e.g., eukaryotic pol I, II or III initiation region); b) a transcription termination region (e.g., eukaryotic pol I, II or III termination region); and c) a nucleic acid sequence encoding at least one of the siNA molecules of the instant invention, wherein said sequence is operably linked to said initiation region and said termination region in a manner that allows expression and/or delivery of the siNA molecule. The vector can optionally include an open reading frame (ORF) for a protein operably linked on the 5' side or the 3'-side of the sequence encoding the siNA of the invention; and/or an intron (intervening sequences).

Transcription of the siNA molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, *Proc. Natl. Acad. Sci. USA*, 87, 6743-7; Gao and Huang 1993, *Nucleic Acids Res.*, 21, 2867-72; Lieber et al., 1993, *Methods Enzymol.*, 217, 47-66; Zhou et al., 1990, *Mol. Cell. Biol.*, 10, 4529-37). Several investigators have demonstrated that nucleic acid molecules expressed from such promoters can function in mammalian cells (e.g. Kashani-Sabet et al., 1992, *Antisense Res. Dev.*, 2, 3-15; Ojwang et al., 1992, *Proc. Natl. Acad. Sci. USA*, 89, 10802-6; Chen et al., 1992, *Nucleic Acids Res.*, 20, 4581-9; Yu et al., 1993, *Proc. Natl. Acad. Sci. USA*, 90, 6340-4; L'Huillier et al., 1992, *EMBO J.*, 11, 4411-8; Lisziewicz et al., 1993, *Proc. Natl. Acad. Sci. USA*, 90, 8000-4; Thompson et al., 1995, *Nucleic Acids Res.*, 23, 2259; Sullenger & Cech, 1993, *Science*, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, *Nucleic Acid Res.*, 22, 2830; Noonberg et al., U.S. Pat. No. 5,624,803; Good et al., 1997, *Gene Ther.*, 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In another aspect the invention features an expression vector comprising a nucleic acid sequence encoding at least one of the siNA molecules of the invention in a manner that allows expression of that siNA molecule. The expression vector comprises in one embodiment; a) a transcription initiation region; b) a transcription termination region; and c) a nucleic acid sequence encoding at least one strand of the siNA molecule, wherein the sequence is operably linked to the initiation region and the termination region in a manner that allows expression and/or delivery of the siNA molecule.

In another embodiment the expression vector comprises: a) a transcription initiation region; b) a transcription termination region; c) an open reading frame; and d) a nucleic acid sequence encoding at least one strand of a siNA molecule, wherein the sequence is operably linked to the 3'-end of the open reading frame and wherein the sequence is operably linked to the initiation region, the open reading frame and the termination region in a manner that allows expression and/or delivery of the siNA molecule. In yet another embodiment, the expression vector comprises: a) a transcription initiation region; b) a transcription termination region; c) an intron; and d) a nucleic acid sequence encoding at least one siNA molecule, wherein the sequence is operably linked to the initiation region, the intron and the termination region in a manner which allows expression and/or delivery of the nucleic acid molecule.

In another embodiment, the expression vector comprises: a) a transcription initiation region; b) a transcription termination region; c) an intron; d) an open reading frame; and e) a nucleic acid sequence encoding at least one strand of a siNA molecule, wherein the sequence is operably linked to the 3'-end of the open reading frame and wherein the sequence is operably linked to the initiation region, the intron, the open reading frame and the termination region in a manner which allows expression and/or delivery of the siNA molecule.

VEGF and/or VEGFR Biology and Biochemistry

The following discussion is adapted from R&D Systems, Cytokine Mini Reviews, Vascular Endothelial Growth Factor (VEGF), Copyright ©2002 R&D Systems. Angiogenesis is a process of new blood vessel development from pre-existing vasculature. It plays an essential role in embryonic development, normal growth of tissues, wound healing, the female reproductive cycle (i.e., ovulation, menstruation and placental development), as well as a major role in many diseases. Particular interest has focused on cancer, since tumors cannot grow beyond a few millimeters in size without developing a new blood supply. Angiogenesis is also necessary for the spread and growth of tumor cell metastases.

One of the most important growth and survival factors for endothelium is vascular endothelial growth factor (VEGF). VEGF induces angiogenesis and endothelial cell proliferation and plays an important role in regulating vasculogenesis. VEGF is a heparin-binding glycoprotein that is secreted as a homodimer of 45 kDa. Most types of cells, but usually not endothelial cells themselves, secrete VEGF. Since the initially discovered VEGF, VEGF-A, increases vascular permeability, it was known as vascular permeability factor. In addition, VEGF causes vasodilatation, partly through stimulation of nitric oxide synthase in endothelial cells. VEGF can also stimulate cell migration and inhibit apoptosis.

There are several splice variants of VEGF-A. The major ones include: 121, 165, 189 and 206 amino acids (aa), each one comprising a specific exon addition. VEGF165 is the most predominant protein, but transcripts of VEGF 121 may be more abundant. VEGF206 is rarely expressed and has been detected only in fetal liver. Recently, other splice variants of 145 and 183 aa have also been described. The 165, 189 and 206 aa splice variants have heparin-binding domains, which help anchor them in extracellular matrix and are involved in binding to heparin sulfate and presentation to VEGF receptors. Such presentation is a key factor for VEGF potency (i.e., the heparin-binding forms are more active). Several other members of the VEGF family have been cloned including VEGF-B, -C, and -D. Placenta growth factor (PlGF) is also closely related to VEGF-A. VEGF-A, -B, -C, -D, and PlGF are all distantly related to platelet-derived growth factors-A and -B. Less is known about the function and regulation of VEGF-B, -C, and -D, but they do not seem to be regulated by the major pathways that regulate VEGF-A.

VEGF-A transcription is potentiated in response to hypoxia and by activated oncogenes. The transcription factors, hypoxia inducible factor-1a (hif-1a) and -2a, are degraded by proteosomes in normoxia and stabilized in hypoxia. This pathway is dependent on the Von Hippel-Lindau gene product. Hif-1a and hif-2 a heterodimerize with the aryl hydrocarbon nuclear translocator in the nucleus and bind the VEGF promoter/enhancer. This is a key pathway expressed in most types of cells. Hypoxia inducibility, in particular, characterizes VEGF-A versus other members of the VEGF family and other angiogenic factors. VEGF transcription in normoxia is activated by many oncogenes, including H-ras and several transmembrane tyrosine kinases, such as the epidermal growth factor receptor and erbB2. These pathways together account for a marked upregulation of VEGF-A in tumors compared to normal tissues and are often of prognostic importance.

There are three receptors in the VEGF receptor family. They have the common properties of multiple IgG-like extracellular domains and tyrosine kinase activity. The enzyme domains of VEGF receptor 1 (VEGFR1, also known as Flt-1), VEGFR2 (also known as KDR or Flk-1), and VEGFR3 (also known as Flt-4) are divided by an inserted sequence. Endothelial cells also express additional VEGF receptors, Neuropilin-1 and Neuropilin-2. VEGF-A binds to VEGFR1 and VEGFR2 and to Neuropilin-1 and Neuropilin-2. PlGF and VEGF-B bind VEGFR1 and Neuropilin-1. VEGF-C and -D bind VEGFR3 and VEGFR2.

The VEGF-C/VEGFR3 pathway is important for lymphatic proliferation. VEGFR3 is specifically expressed on lymphatic endothelium. A soluble form of Flt-1 can be detected in peripheral blood and is a high affinity ligand for VEGF. Soluble Flt-1 can be used to antagonize VEGF function. VEGFR1 and VEGFR2 are upregulated in tumor and proliferating endothelium, partly by hypoxia and also in response to VEGF-A itself. VEGFR1 and VEGFR2 can interact with multiple downstream signaling pathways via proteins such as PLC-g, Ras, Shc, Nck, PKC and PI3-kinase. VEGFR1 is of higher affinity than VEGFR2 and mediates motility and vascular permeability. VEGFR2 is necessary for proliferation.

VEGF can be detected in both plasma and serum samples of patients, with much higher levels in serum. Platelets release VEGF upon aggregation and may be a major source of VEGF delivery to tumors. Several studies have shown that association of high serum levels of VEGF with poor prognosis in cancer patients may be correlated with an elevated platelet count. Many tumors release cytokines that can stimulate the production of megakaryocytes in the marrow and elevate the platelet count. This can result in an indirect increase of VEGF delivery to tumors.

VEGF is implicated in several other pathological conditions associated with enhanced angiogenesis. For example, VEGF plays a role in both psoriasis and rheumatoid arthritis. Diabetic retinopathy is associated with high intraocular levels of VEGF. Inhibition of VEGF function may result in infertility by blockade of corpus luteum function. Direct demonstration of the importance of VEGF in tumor growth has been achieved using dominant negative VEGF receptors to block in vivo proliferation, as well as blocking antibodies to VEGF39 or to VEGFR2.

Targeting of VEGFR1 can be useful in disrupting VEGF signaling pathways by mediating inhibition of VEGFR1 and VEGFR2 expression. Kou et al., 2005, *Biochemistry*, 44: 15064-15073 report that inhibition of VEGFR1 using siRNA significantly inhibited VEGFR2 promoter activity as well as VEGFR1 expression.

The use of small interfering nucleic acid molecules targeting VEGF and corresponding receptors and ligands therefore provides a class of novel therapeutic agents that can be used in the diagnosis of and the treatment of inflammatory diseases and conditions, respiratory diseases and conditions, allergic diseases and conditions, autoimmune diseases and conditions, neurologic diseases and conditions, ocular diseases and conditions, and cancer and other proliferative diseases and conditions, or any other disease or condition that responds to modulation of VEGF and/or VEGFR genes or other genes involved in VEGF and/or VEGFR biologic pathways, such as interleukins and interleukin receptors.

EXAMPLES

The following are non-limiting examples showing the selection, isolation, synthesis and activity of nucleic acids of the instant invention.

Example 1

Tandem Synthesis of siNA Constructs

Exemplary siNA molecules of the invention are synthesized in tandem using a cleavable linker, for example, a succinyl-based linker. Tandem synthesis as described herein is followed by a one-step purification process that provides RNAi molecules in high yield. This approach is highly amenable to siNA synthesis in support of high throughput RNAi screening, and can be readily adapted to multi-column or multi-well synthesis platforms.

After completing a tandem synthesis of a siNA oligo and its complement in which the 5'-terminal dimethoxytrityl (5'-O-DMT) group remains intact (trityl on synthesis), the oligonucleotides are deprotected as described above. Following deprotection, the siNA sequence strands are allowed to spontaneously hybridize. This hybridization yields a duplex in which one strand has retained the 5'-O-DMT group while the complementary strand comprises a terminal 5'-hydroxyl. The newly formed duplex behaves as a single molecule during routine solid-phase extraction purification (Trityl-On purification) even though only one molecule has a dimethoxytrityl group. Because the strands form a stable duplex, this dimethoxytrityl group (or an equivalent group, such as other trityl groups or other hydrophobic moieties) is all that is required to purify the pair of oligos, for example, by using a C18 cartridge.

Standard phosphoramidite synthesis chemistry is used up to the point of introducing a tandem linker, such as an inverted deoxy abasic succinate or glyceryl succinate linker (see FIG. 1) or an equivalent cleavable linker. A non-limiting example of linker coupling conditions that can be used includes a hindered base such as diisopropylethylamine (DIPA) and/or DMAP in the presence of an activator reagent such as Bromotripyrrolidinophosphoniumhexaflurorophosphate (Py-BrOP). After the linker is coupled, standard synthesis chemistry is utilized to complete synthesis of the second sequence leaving the terminal the 5'-O-DMT intact. Following synthesis, the resulting oligonucleotide is deprotected according to the procedures described herein and quenched with a suitable buffer, for example with 50 mM NaOAc or 1.5M $NH_4H_2CO_3$.

Purification of the siNA duplex can be readily accomplished using solid phase extraction, for example, using a Waters C18 SepPak 1 g cartridge conditioned with 1 column volume (CV) of acetonitrile, 2 CV H2O, and 2 CV 50 mM NaOAc. The sample is loaded and then washed with 1 CV H2O or 50 mM NaOAc. Failure sequences are eluted with 1 CV 14% ACN (Aqueous with 50 mM NaOAc and 50 mM NaCl). The column is then washed, for example with 1 CV H2O followed by on-column detritylation, for example by passing 1 CV of 1% aqueous trifluoroacetic acid (TFA) over the column, then adding a second CV of 1% aqueous TFA to the column and allowing to stand for approximately 10 minutes. The remaining TFA solution is removed and the column washed with H2O followed by 1 CV 1M NaCl and additional H2O. The siNA duplex product is then eluted, for example, using 1 CV 20% aqueous CAN.

Figure 2:
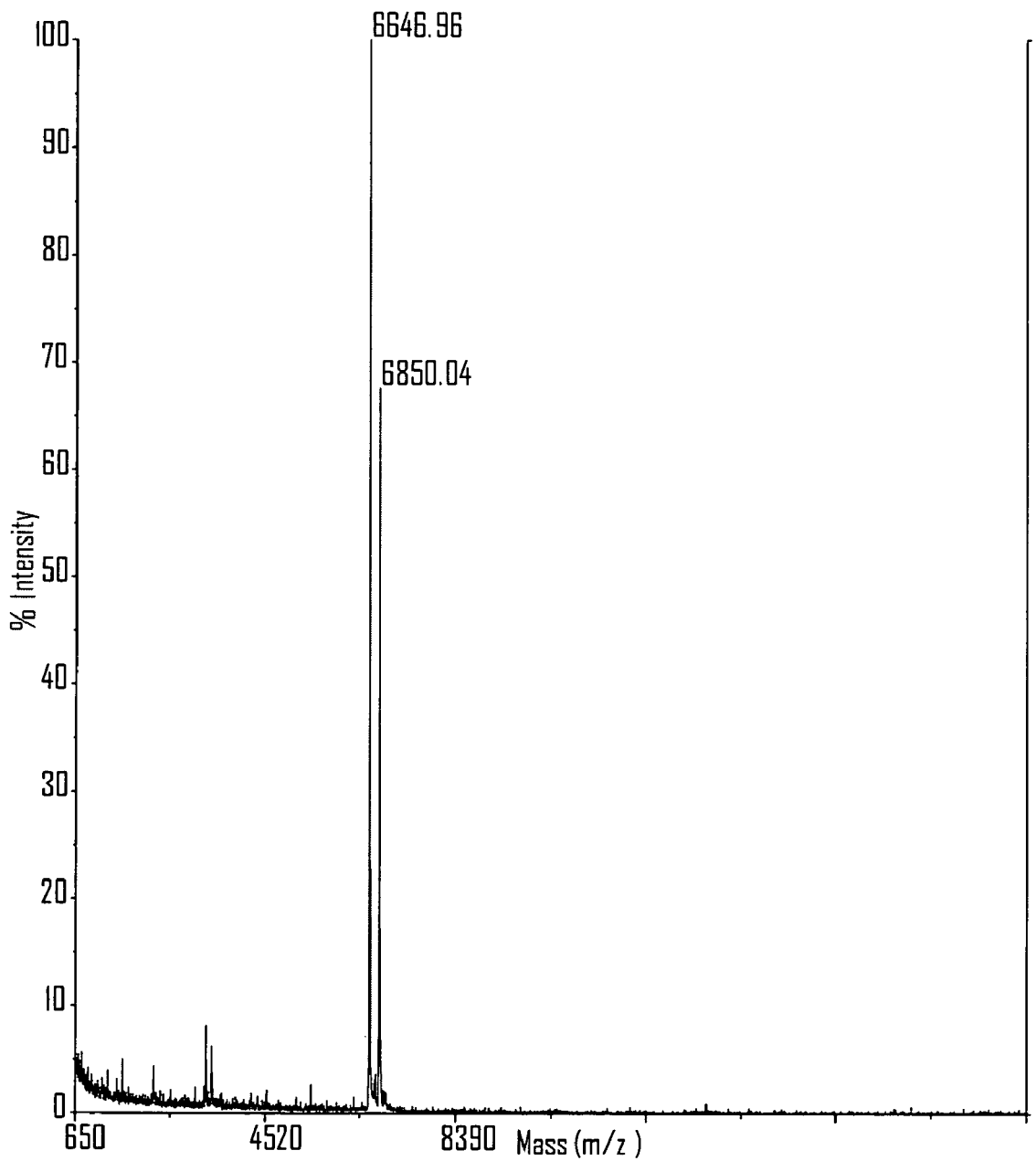
FIG. 2 shows a MALDI-TOF mass spectrum of a purified siNA duplex synthesized by a method of the invention. The two peaks shown correspond to the predicted mass of the separate siNA sequence strands. This result demonstrates that the siNA duplex generated from tandem synthesis can be purified as a single entity using a simple trityl-on purification methodology.
Figure 3:
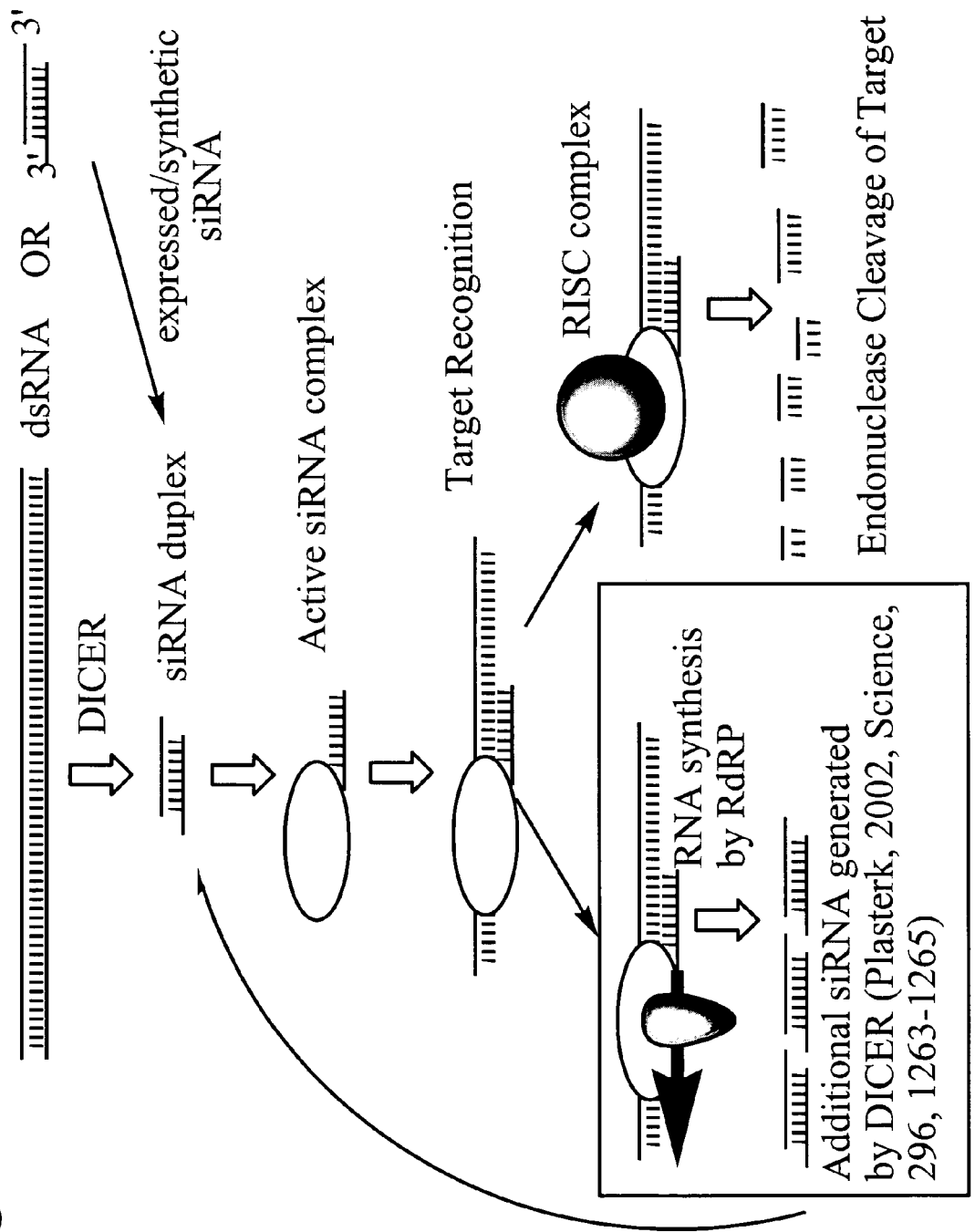
FIG. 3 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms which recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.

FIG. 2 provides an example of MALDI-TOF mass spectrometry analysis of a purified siNA construct in which each peak corresponds to the calculated mass of an individual siNA strand of the siNA duplex. The same purified siNA provides three peaks when analyzed by capillary gel electrophoresis (CGE), one peak presumably corresponding to the duplex siNA, and two peaks presumably corresponding to the separate siNA sequence strands. Ion exchange HPLC analysis of the same siNA contract only shows a single peak. Testing of the purified siNA construct using a luciferase reporter assay described below demonstrated the same RNAi activity compared to siNA constructs generated from separately synthesized oligonucleotide sequence strands.

Example 2

Identification of Potential siNA Target Sites in any RNA Sequence

The sequence of an RNA target of interest, such as a viral or human mRNA transcript, is screened for target sites, for example by using a computer folding algorithm. In a non-limiting example, the sequence of a gene or RNA gene transcript derived from a database, such as Genbank, is used to generate siNA targets having complementarity to the target. Such sequences can be obtained from a database, or can be determined experimentally as known in the art. Target sites that are known, for example, those target sites determined to be effective target sites based on studies with other nucleic acid molecules, for example ribozymes or antisense, or those targets known to be associated with a disease, trait, or condition such as those sites containing mutations or deletions, can be used to design siNA molecules targeting those sites. Various parameters can be used to determine which sites are the most suitable target sites within the target RNA sequence. These parameters include but are not limited to secondary or tertiary RNA structure, the nucleotide base composition of the target sequence, the degree of homology between various regions of the target sequence, or the relative position of the target sequence within the RNA transcript. Based on these determinations, any number of target sites within the RNA transcript can be chosen to screen siNA molecules for efficacy, for example by using in vitro RNA cleavage assays, cell culture, or animal models. In a non-limiting example, anywhere from 1 to 1000 target sites are chosen within the transcript based on the size of the siNA construct to be used. High throughput screening assays can be developed for screening siNA molecules using methods known in the art, such as with multi-well or multi-plate assays to determine efficient reduction in target gene expression.

Example 3

Selection of siNA Molecule Target Sites in a RNA

The following non-limiting steps can be used to carry out the selection of siNAs targeting a given gene sequence or transcript.

1. The target sequence is parsed in silico into a list of all fragments or subsequences of a particular length, for example 23 nucleotide fragments, contained within the target sequence. This step is typically carried out using a custom Perl script, but commercial sequence analysis programs such as Oligo, MacVector, or the GCG Wisconsin Package can be employed as well.

2. In some instances the siNAs correspond to more than one target sequence; such would be the case for example in targeting different transcripts of the same gene, targeting different transcripts of more than one gene, or for targeting both the human gene and an animal homolog. In this case, a subsequence list of a particular length is generated for each of the targets, and then the lists are compared to find matching sequences in each list. The subsequences are then ranked according to the number of target sequences that contain the given subsequence; the goal is to find subsequences that are present in most or all of the target sequences. Alternately, the ranking can identify subsequences that are unique to a target sequence, such as a mutant target sequence. Such an approach would enable the use of siNA to target specifically the mutant sequence and not effect the expression of the normal sequence.

3. In some instances the siNA subsequences are absent in one or more sequences while present in the desired target sequence; such would be the case if the siNA targets a gene with a paralogous family member that is to remain untargeted. As in case 2 above, a subsequence list of a particular length is generated for each of the targets, and then the lists are compared to find sequences that are present in the target gene but are absent in the untargeted paralog.

4. The ranked siNA subsequences can be further analyzed and ranked according to GC content. A preference can be given to sites containing 30-70% GC, with a further preference to sites containing 40-60% GC.

5. The ranked siNA subsequences can be further analyzed and ranked according to self-folding and internal hairpins. Weaker internal folds are preferred; strong hairpin structures are to be avoided.

6. The ranked siNA subsequences can be further analyzed and ranked according to whether they have runs of GGG or CCC in the sequence. GGG (or even more Gs) in either strand can make oligonucleotide synthesis problematic and can potentially interfere with RNAi activity, so it is avoided whenever better sequences are available. CCC is searched in the target strand because that will place GGG in the antisense strand.

7. The ranked siNA subsequences can be further analyzed and ranked according to whether they have the dinucleotide UU (uridine dinucleotide) on the 3'-end of the sequence, and/or AA on the 5'-end of the sequence (to yield 3' U on the antisense sequence). These sequences allow one to design siNA molecules with terminal TT thymidine dinucleotides.

8. Four or five target sites are chosen from the ranked list of subsequences as described above. For example, in subsequences having 23 nucleotides, the right 21 nucleotides of each chosen 23-mer subsequence are then designed and synthesized for the upper (sense) strand of the siNA duplex, while the reverse complement of the left 21 nucleotides of each chosen 23-mer subsequence are then designed and synthesized for the lower (antisense) strand of the siNA duplex (see Table II). If terminal TT residues are desired for the sequence (as described in paragraph 7), then the two 3' terminal nucleotides of both the sense and antisense strands are replaced by TT prior to synthesizing the oligos.

9. The siNA molecules are screened in an in vitro, cell culture or animal model system to identify the most active siNA molecule or the most preferred target site within the target RNA sequence.

10. Other design considerations can be used when selecting target nucleic acid sequences, see, for example, Reynolds et al., 2004, *Nature Biotechnology Advanced Online Publication*, 1 Feb. 2004, doi:10.1038/nbt936 and Ui-Tei et al., 2004, Nucleic Acids Research, 32, doi:10.1093/nar/gkh247.

Figure 9:
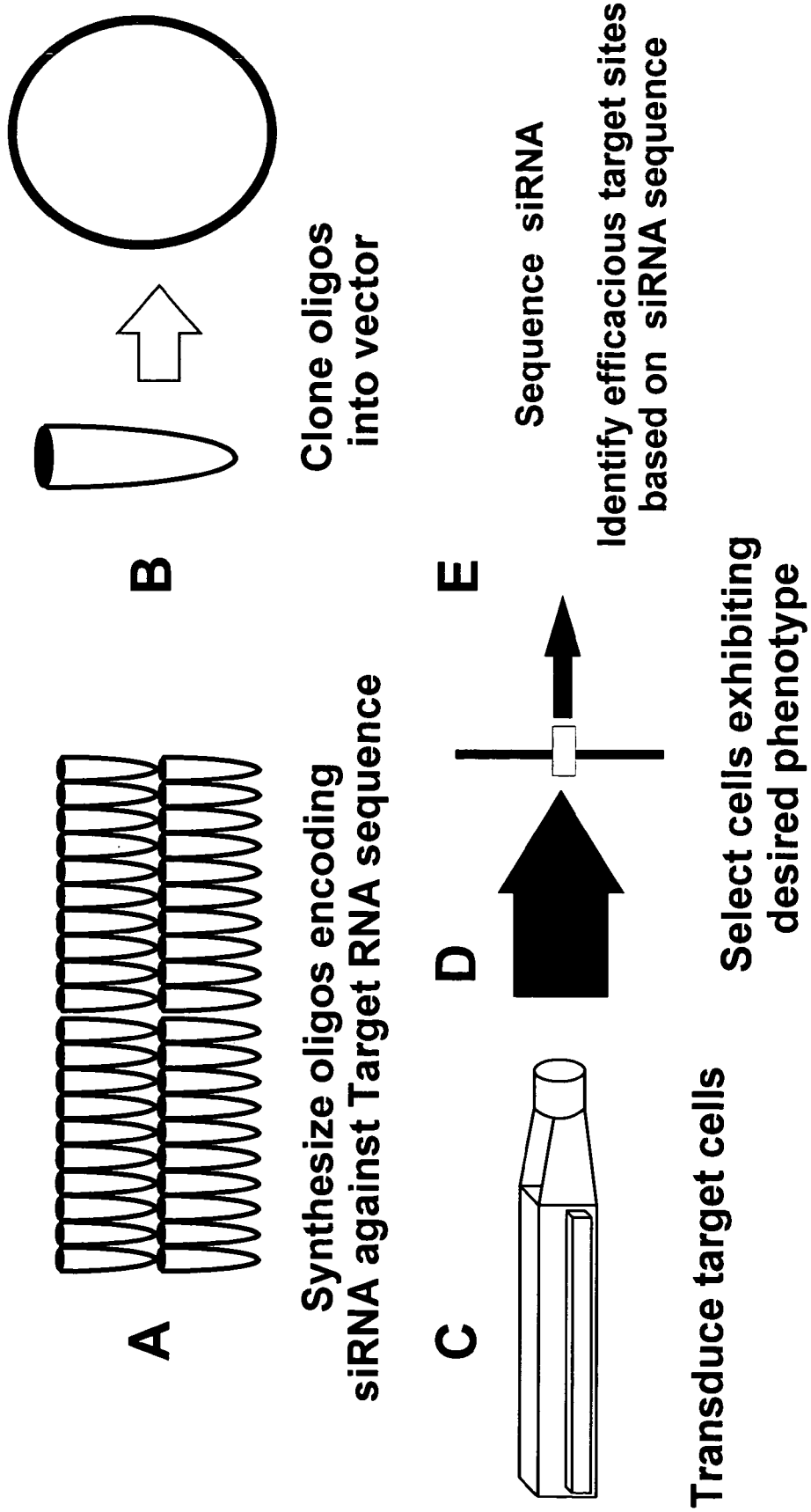

In an alternate approach, a pool of siNA constructs specific to a target sequence is used to screen for target sites in cells expressing target RNA, such as cultured Jurkat, HeLa, A549 or 293T cells. The general strategy used in this approach is shown in FIG. 9. Cells expressing the target RNA are transfected with the pool of siNA constructs and cells that demonstrate a phenotype associated with target inhibition are sorted. The pool of siNA constructs can be expressed from transcription cassettes inserted into appropriate vectors (see for example FIG. 7 and FIG. 8). The siNA from cells demonstrating a positive phenotypic change (e.g., decreased proliferation, decreased target mRNA levels or decreased target protein expression), are sequenced to determine the most suitable target site(s) within the target RNA sequence.

Example 4 siNA Design siNA target sites were chosen by analyzing sequences of the VEGF and/or VEGFR RNA target and optionally prioritizing the target sites on the basis of folding (structure of any given sequence analyzed to determine siNA accessibility to the target), by using a library of siNA molecules as described in Example 3, or alternately by using an in vitro siNA system as described in Example 6 herein siNA molecules were designed that could bind each target and are optionally individually analyzed by computer folding to assess whether the siNA molecule can interact with the target sequence. Varying the length of the siNA molecules can be chosen to optimize activity. Generally, a sufficient number of complementary nucleotide bases are chosen to bind to, or otherwise interact with, the target RNA, but the degree of complementarity can be modulated to accommodate siNA duplexes or varying length or base composition. By using such methodologies, siNA molecules can be designed to target sites within any known RNA sequence, for example those RNA sequences corresponding to the any gene transcript.

Chemically modified siNA constructs are designed to provide nuclease stability for systemic administration in vivo and/or improved pharmacokinetic, localization, and delivery properties while preserving the ability to mediate RNAi activity. Chemical modifications as described herein are introduced synthetically using synthetic methods described herein and those generally known in the art. The synthetic siNA constructs are then assayed for nuclease stability in serum and/or cellular/tissue extracts (e.g. liver extracts). The synthetic siNA constructs are also tested in parallel for RNAi activity using an appropriate assay, such as a luciferase reporter assay as described herein or another suitable assay that can quantity RNAi activity. Synthetic siNA constructs that possess both nuclease stability and RNAi activity can be further modified and re-evaluated in stability and activity assays. The chemical modifications of the stabilized active siNA constructs can then be applied to any siNA sequence targeting any chosen RNA and used, for example, in target screening assays to pick lead siNA compounds for therapeutic development (see for example FIG. 11).

Example 5

Chemical Synthesis and Purification of siNA siNA molecules can be designed to interact with various sites in the RNA message, for example, target sequences within the RNA sequences described herein. The sequence of one strand of the siNA molecule(s) is complementary to the target site sequences described above. The siNA molecules can be chemically synthesized using methods described herein. Inactive siNA molecules that are used as control sequences can be synthesized by scrambling the sequence of the siNA molecules such that it is not complementary to the target sequence. Generally, siNA constructs can by synthesized using solid phase oligonucleotide synthesis methods as described herein (see for example Usman et al., U.S. Pat. Nos. 5,804,683; 5,831,071; 5,998,203; 6,117,657; 6,353,098; 6,362,323; 6,437,117; 6,469,158; Scaringe et al, U.S. Pat. Nos. 6,111,086; 6,008,400; 6,111,086 all incorporated by reference herein in their entirety).

In a non-limiting example, RNA oligonucleotides are synthesized in a stepwise fashion using the phosphoramidite chemistry as is known in the art. Standard phosphoramidite chemistry involves the use of nucleosides comprising any of 5'-O-dimethoxytrityl, 2'-O-tert-butyldimethylsilyl, 3'-O-2-Cyanoethyl N,N-diisopropylphos-phoroamidite groups, and exocyclic amine protecting groups (e.g. N6-benzoyl adenosine, N4 acetyl cytidine, and N2-isobutyryl guanosine). Alternately, 2'-O-Silyl Ethers can be used in conjunction with acid-labile 2'-O-orthoester protecting groups in the synthesis of RNA as described by Scaringe supra. Differing 2' chemistries can require different protecting groups, for example 2'-deoxy-2'-amino nucleosides can utilize N-phthaloyl protection as described by Usman et al., U.S. Pat. No. 5,631,360, incorporated by reference herein in its entirety).

During solid phase synthesis, each nucleotide is added sequentially (3'- to 5'-direction) to the solid support-bound oligonucleotide. The first nucleoside at the 3'-end of the chain is covalently attached to a solid support (e.g., controlled pore glass or polystyrene) using various linkers. The nucleotide precursor, a ribonucleoside phosphoramidite, and activator are combined resulting in the coupling of the second nucleoside phosphoramidite onto the 5'-end of the first nucleoside. The support is then washed and any unreacted 5'-hydroxyl groups are capped with a capping reagent such as acetic anhydride to yield inactive 5'-acetyl moieties. The trivalent phosphorus linkage is then oxidized to a more stable phosphate linkage. At the end of the nucleotide addition cycle, the 5'-O-protecting group is cleaved under suitable conditions (e.g., acidic conditions for trityl-based groups and Fluoride for silyl-based groups). The cycle is repeated for each subsequent nucleotide.

Modification of synthesis conditions can be used to optimize coupling efficiency, for example by using differing coupling times, differing reagent/phosphoramidite concentrations, differing contact times, differing solid supports and solid support linker chemistries depending on the particular chemical composition of the siNA to be synthesized. Deprotection and purification of the siNA can be performed as is generally described in Usman et al., U.S. Pat. Nos. 5,831,071, 6,353,098, 6,437,117, and Bellon et al., U.S. Pat. Nos. 6,054,576, 6,162,909, 6,303,773, or Scaringe supra, incorporated by reference herein in their entireties. Additionally, deprotection conditions can be modified to provide the best possible yield and purity of siNA constructs. For example, applicant has observed that oligonucleotides comprising 2'-deoxy-2'-fluoro nucleotides can degrade under inappropriate deprotection conditions. Such oligonucleotides are deprotected using aqueous methylamine at about 35° C. for 30 minutes. If the 2'-deoxy-2'-fluoro containing oligonucleotide also comprises ribonucleotides, after deprotection with aqueous methylamine at about 35° C. for 30 minutes, TEA-HF is added and the reaction maintained at about 65° C. for an additional 15 minutes.

Example 6

RNAi in vitro Assay to Assess siNA Activity

An in vitro assay that recapitulates RNAi in a cell-free system is used to evaluate siNA constructs targeting VEGF and/or VEGFR RNA targets. The assay comprises the system described by Tuschl et al., 1999, *Genes and Development,* 13, 3191-3197 and Zamore et al., 2000, *Cell,* 101, 25-33 adapted for use with a target RNA. A *Drosophila* extract derived from syncytial blastoderm is used to reconstitute RNAi activity in vitro. Target RNA is generated via in vitro transcription from an appropriate target expressing plasmid using T7 RNA polymerase or via chemical synthesis as described herein. Sense and antisense siNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing siNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25×Passive Lysis Buffer (Promega). Target RNA cleavage is assayed by RT-PCR analysis or other methods known in the art and are compared to control reactions in which siNA is omitted from the reaction.

Alternately, internally-labeled target RNA for the assay is prepared by in vitro transcription in the presence of [alpha-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without siNA and the cleavage products generated by the assay.

In one embodiment, this assay is used to determine target sites in the VEGF and/or VEGFR RNA target for siNA mediated RNAi cleavage, wherein a plurality of siNA constructs are screened for RNAi mediated cleavage of the VEGF and/or VEGFR RNA target, for example, by analyzing the assay reaction by electrophoresis of labeled target RNA, or by northern blotting, as well as by other methodology well known in the art.

Example 7

Nucleic Acid Inhibition of VEGF and/or VEGFR Target RNA in vivo siNA molecules targeted to the human VEGF and/or VEGFR RNA are designed and synthesized as described above. These nucleic acid molecules can be tested for cleavage activity in vivo, for example, using the following procedure. The target sequences and the nucleotide location within the VEGF and/or VEGFR RNA are given in Table II and III.

Two formats are used to test the efficacy of siNAs targeting VEGF and/or VEGFR. First, the reagents are tested in cell culture using, for example, HUVEC, HMVEC, or A375 cells to determine the extent of RNA and protein inhibition siNA reagents (e.g.; see Tables II and III) are selected against the VEGF and/or VEGFR target as described herein. RNA inhibition is measured after delivery of these reagents by a suitable transfection agent to, for example, HUVEC, HMVEC, or A375 cells. Relative amounts of target RNA are measured versus actin using real-time PCR monitoring of amplification (eg., ABI 7700 TAQMAN®). A comparison is made to a mixture of oligonucleotide sequences made to unrelated targets or to a randomized siNA control with the same overall length and chemistry, but randomly substituted at each position. Primary and secondary lead reagents are chosen for the target and optimization performed. After an optimal transfection agent concentration is chosen, a RNA time-course of inhibition is performed with the lead siNA molecule. In addition, a cell-plating format can be used to determine RNA inhibition.

Delivery of siNA to Cells

Cells (e.g., HUVEC, HMVEC, or A375 cells) are seeded, for example, at 1×105 cells per well of a six-well dish in EGM-2 (BioWhittaker) the day before transfection. siNA (final concentration, for example 20 nM) and cationic lipid (e.g., final concentration 2☐g/ml) are complexed in EGM basal media (Biowhittaker) at 37° C. for 30 minutes in polystyrene tubes. Following vortexing, the complexed siNA is added to each well and incubated for the times indicated. For initial optimization experiments, cells are seeded, for example, at 1×103 in 96 well plates and siNA complex added as described. Efficiency of delivery of siNA to cells is determined using a fluorescent siNA complexed with lipid. Cells in 6-well dishes are incubated with siNA for 24 hours, rinsed with PBS and fixed in 2% paraformaldehyde for 15 minutes at room temperature. Uptake of siNA is visualized using a fluorescent microscope.

TAQMAN® (Real-Time PCR Monitoring of Amplification) and Lightcycler Quantification of mRNA Total RNA is prepared from cells following siNA delivery, for example, using Qiagen RNA purification kits for 6-well or Rneasy extraction kits for 96-well assays. For TAQMAN® analysis (real-time PCR monitoring of amplification), dual-labeled probes are synthesized with the reporter dye, FAM or JOE, covalently linked at the 5'-end and the quencher dye TAMRA conjugated to the 3'-end. One-step RT-PCR amplifications are performed on, for example, an ABI PRISM 7700 Sequence Detector using 50 µl reactions consisting of 10 µl total RNA, 100 nM forward primer, 900 nM reverse primer, 100 nM probe, 1× TaqMan PCR reaction buffer (PE-Applied Biosystems), 5.5 mM MgCl2, 300 µM each dATP, dCTP, dGTP, and dTTP, 10U RNase Inhibitor (Promega), 1.25U AMPLITAQ GOLD® (DNA polymerase) (PE-Applied Biosystems) and 10U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of mRNA levels is determined relative to standards generated from serially diluted total cellular RNA (300, 100, 33, 11 ng/reaction) and normalizing to β-actin or GAPDH mRNA in parallel TAQMAN® reactions (real-time PCR monitoring of amplification). For each gene of interest an upper and lower primer and a fluorescently labeled probe are designed. Real time incorporation of SYBR Green I dye into a specific PCR product can be measured in glass capillary tubes using a lightcyler. A standard curve is generated for each primer pair using control cRNA. Values are represented as relative expression to GAPDH in each sample.

Western Blotting

Nuclear extracts can be prepared using a standard micro preparation technique (see for example Andrews and Faller, 1991, Nucleic Acids Research, 19, 2499). Protein extracts from supernatants are prepared, for example using TCA precipitation. An equal volume of 20% TCA is added to the cell supernatant, incubated on ice for 1 hour and pelleted by centrifugation for 5 minutes. Pellets are washed in acetone, dried and resuspended in water. Cellular protein extracts are run on a 10% Bis-Tris NuPage (nuclear extracts) or 4-12% Tris-Glycine (supernatant extracts) polyacrylamide gel and transferred onto nitro-cellulose membranes. Non-specific binding can be blocked by incubation, for example, with 5% non-fat milk for 1 hour followed by primary antibody for 16 hour at 4° C. Following washes, the secondary antibody is applied, for example (1:10,000 dilution) for 1 hour at room temperature and the signal detected with SuperSignal reagent (Pierce).

Example 8

Animal Models Useful to Evaluate the Down-Regulation of VEGF and/or VEGFR Gene Expression There are several animal models in which the anti-angiogenesis effect of nucleic acids of the present invention, such as siRNA, directed against VEGF, VEGFR1, VEGFR2 and/or VEGFR3 mRNAs can be tested. Typically a corneal model has been used to study angiogenesis in rat and rabbit since recruitment of vessels can easily be followed in this normally avascular tissue (Pandey et al., 1995 Science 268: 567-569). In these models, a small Teflon or Hydron disk pretreated with an angiogenesis factor (e.g. bFGF or VEGF) is inserted into a pocket surgically created in the cornea. Angiogenesis is monitored 3 to 5 days later. siRNA directed against VEGF, VEGFR1, VEGFR2 and/or VEGFR3 mRNAs are delivered in the disk as well, or dropwise to the eye over the time course of the experiment. In another eye model, hypoxia has been shown to cause both increased expression of VEGF and neovascularization in the retina (Pierce et al., 1995 Proc. Natl. Acad. Sci. USA. 92: 905-909; Shweiki et al., 1992 J. Clin. Invest. 91: 2235-2243).

In human glioblastomas, it has been shown that VEGF is at least partially responsible for tumor angiogenesis (Plate et al., 1992 Nature 359, 845). Animal models have been developed in which glioblastoma cells are implanted subcutaneously into nude mice and the progress of tumor growth and angiogenesism is studied (Kim et al., 1993 supra; Millauer et al., 1994 supra).

Another animal model that addresses neovascularization involves Matrigel, an extract of basement membrane that becomes a solid gel when injected subcutaneously (Passaniti et al., 1992 Lab. Invest. 67: 519-528). When the Matrigel is supplemented with angiogenesis factors such as VEGF, vessels grow into the Matrigel over a period of 3 to 5 days and angiogenesis can be assessed. Again, nucleic acids directed against VEGFR mRNAs are delivered in the Matrigel.

Several animal models exist for screening of anti-angiogenic agents. These include corneal vessel formation following corneal injury (Burger et al., 1985 Cornea 4: 35-41; Lepri, et al., 1994 J. Ocular Pharmacol. 10: 273-280; Ormerod et al., 1990 Am. J. Pathol. 137: 1243-1252) or intracorneal growth factor implant (Grant et al., 1993 Diabetologia 36: 282-291; Pandey et al. 1995 supra; Zieche et al., 1992 Lab. Invest. 67: 711-715), vessel growth into Matrigel matrix containing growth factors (Passaniti et al., 1992 supra), female reproductive organ neovascularization following hormonal manipulation (Shweiki et al., 1993 Clin. Invest. 91: 2235-2243), several models involving inhibition of tumor growth in highly vascularized solid tumors (O'Reilly et al., 1994 Cell 79: 315-328; Senger et al., 1993 Cancer and Metas. Rev. 12: 303-324; Takahasi et al., 1994 Cancer Res. 54: 4233-4237; Kim et al., 1993 supra), and transient hypoxia-induced neovascularization in the mouse retina (Pierce et al., 1995 Proc. Natl. Acad. Sci. USA. 92: 905-909). Other model systems to study tumor angiogenesis are reviewed by Folkman, 1985 Adv. Cancer. Res. 43, 175.

Ocular Models of Angiogenesis

The cornea model, described in Pandey et al. supra, is the most common and well characterized model for screening anti-angiogenic agent efficacy. This model involves an avascular tissue into which vessels are recruited by a stimulating agent (growth factor, thermal or alkalai burn, endotoxin). The corneal model utilizes the intrastromal corneal implantation of a Teflon pellet soaked in a VEGF-Hydron solution to recruit blood vessels toward the pellet, which can be quantitated using standard microscopic and image analysis techniques. To evaluate their anti-angiogenic efficacy, nucleic acids are applied topically to the eye or bound within Hydron on the Teflon pellet itself. This avascular cornea as well as the Matrigel (see below) provide for low background assays. While the corneal model has been performed extensively in the rabbit, studies in the rat have also been conducted.

The mouse model (Passaniti et al., supra) is a non-tissue model that utilizes Matrigel, an extract of basement membrane (Kleinman et al., 1986) or Millipore® filter disk, which can be impregnated with growth factors and anti-angiogenic agents in a liquid form prior to injection. Upon subcutaneous administration at body temperature, the Matrigel or Millipore® filter disk forms a solid implant. VEGF embedded in the Matrigel or Millipore® filter disk is used to recruit vessels within the matrix of the Matrigel or Millipore® filter disk which can be processed histologically for endothelial cell specific vWF (factor VIII antigen) immunohistochemistry, Trichrome-Masson stain, or hemoglobin content. Like the cornea, the Matrigel or Millipore® filter disk is avascular; however, it is not tissue. In the Matrigel or Millipore® filter disk model, nucleic acids are administered within the matrix of the Matrigel or Millipore® filter disk to test their anti-angiogenic efficacy. Thus, delivery issues in this model, as with delivery of nucleic acids by Hydron-coated Teflon pellets in the rat cornea model, may be less problematic due to the homogeneous presence of the nucleic acid within the respective matrix.

Additionally, siNA molecules of the invention targeting VEGF and/or VEGFR (e.g. VEGFR1, VEGFR2, and/or VEGFR3) can be assessed for activity transgenic mice to determine whether modulation of VEGF and/or VEGFR can inhibit optic neovasculariation. Animal models of choroidal neovascularization are described in, for example, Mori et al., 2001, Journal of Cellular Physiology, 188, 253; Mori et al., 2001, American Journal of Pathology, 159, 313; Ohno-Matsui et al., 2002, American Journal of Pathology, 160, 711; and Kwak et al., 2000, Investigative Ophthalmology & Visual Science, 41, 3158. VEGF plays a central role in causing retinal neovascularization. Increased expression of VEGFR2 in retinal photoreceptors of transgenic mice stimulates neovascularization within the retina, and a blockade of VEGFR2 signaling has been shown to inhibit retinal choroidal neovascularization (CNV) (Mori et al.,2001, J. Cell. Physiol., 188, 253).

CNV is laser induced in, for example, adult C57BL/6 mice. The mice are also given an intravitreous, periocular or a subretinal injection of VEGF and/or VEGFR (e.g., VEGFR2) siNA in each eye. Intravitreous injections are made using a Harvard pump microinjection apparatus and pulled glass micropipets. Then a micropipette is passed through the sclera just behind the limbus into the vitreous cavity. The subretinal injections are made using a condensing lens system on a dissecting microscope. The pipet tip is then passed through the sclera posterior to the limbus and positioned above the retina. Five days after the injection of the vector the mice are anesthetized with ketamine hydrochloride (100 mg/kg body weight), 1% tropicamide is also used to dilate the pupil, and a diode laser photocoagulation is used to rupture Bruch's membrane at three locations in each eye. A slit lamp delivery system and a hand-held cover slide are used for laser photocoagulation. Burns are made in the 9, 12, and 3 o'clock positions 2-3 disc diameters from the optic nerve (Mori et al., supra).

The mice typically develop subretinal neovasculariation due to the expression of VEGF in photoreceptors beginning at prenatal day 7. At prenatal day 21, the mice are anesthetized and perfused with 1 ml of phosphate-buffered saline containing 50 mg/ml of fluorescein-labeled dextran. Then the eyes are removed and placed for 1 hour in a 10% phosphate-buffered formalin. The retinas are removed and examined by fluorescence microscopy (Mori et al., supra).

Fourteen days after the laser induced rupture of Bruch's membrane, the eyes that received intravitreous and subretinal injection of siNA are evaluated for smaller appearing areas of CNV, while control eyes are evaluated for large areas of CNV. The eyes that receive intravitreous injections or a subretinal injection of siNA are also evaluated for fewer areas of neovasculariation on the outer surface of the retina and potential abortive sprouts from deep retinal capillaries that do not reach the retinal surface compared to eyes that did not receive an injection of siNA.

Tumor Models of Angiogenesis

Use of Murine Models

For a typical systemic study involving 10 mice (20 g each) per dose group, 5 doses (1, 3, 10, 30 and 100 mg/kg daily over 14 days continuous administration), approximately 400 mg of siRNA, formulated in saline is used. A similar study in young adult rats (200 g) requires over 4 g. Parallel pharmacokinetic studies involve the use of similar quantities of siRNA further justifying the use of murine models.

Lewis Lung Carcinoma and B-16 Melanoma Murine Models

Identifying a common animal model for systemic efficacy testing of nucleic acids is an efficient way of screening siNA for systemic efficacy.

The Lewis lung carcinoma and B-16 murine melanoma models are well accepted models of primary and metastatic cancer and are used for initial screening of anti-cancer agents. These murine models are not dependent upon the use of immunodeficient mice, are relatively inexpensive, and minimize housing concerns. Both the Lewis lung and B-16 melanoma models involve subcutaneous implantation of approximately 106 tumor cells from metastatically aggressive tumor cell lines (Lewis lung lines 3LL or D122, LLc-LN7; B-16-BL6 melanoma) in C57BL/6J mice. Alternatively, the Lewis lung model can be produced by the surgical implantation of tumor spheres (approximately 0.8 mm in diameter). Metastasis also can be modeled by injecting the tumor cells directly intravenously. In the Lewis lung model, microscopic metastases can be observed approximately 14 days following implantation with quantifiable macroscopic metastatic tumors developing within 21-25 days. The B-16 melanoma exhibits a similar time course with tumor neovascularization beginning 4 days following implantation. Since both primary and metastatic tumors exist in these models after 21-25 days in the same animal, multiple measurements can be taken as indices of efficacy. Primary tumor volume and growth latency as well as the number of micro- and macroscopic metastatic lung foci or number of animals exhibiting metastases can be quantitated. The percent increase in lifespan can also be measured. Thus, these models provide suitable primary efficacy assays for screening systemically administered siRNA nucleic acids and siRNA nucleic acid formulations.

In the Lewis lung and B-16 melanoma models, systemic pharmacotherapy with a wide variety of agents usually begins 1-7 days following tumor implantation/inoculation with either continuous or multiple administration regimens. Concurrent pharmacokinetic studies can be performed to determine whether sufficient tissue levels of siRNA can be achieved for pharmacodynamic effect to be expected. Furthermore, primary tumors and secondary lung metastases can be removed and subjected to a variety of in vitro studies (i.e. target RNA reduction).

Renal Disease Models

In addition, animal models are useful in screening compounds, eg. siNA molecules, for efficacy in treating renal failure, such as a result of autosomal dominant polycystic kidney disease (ADPKD). The Han:SPRD rat model, mice with a targeted mutation in the Pkd2 gene and congenital polycystic kidney (cpk) mice, closely resemble human ADPKD and provide animal models to evaluate the therapeutic effect of siRNA constructs that have the potential to interfere with one or more of the pathogenic elements of ADPKD mediated renal failure, such as angiogenesis. Angiogenesis may be necessary in the progression of ADPKD for growth of cyst cells as well as increased vascular permeability promoting fluid secretion into cysts. Proliferation of cystic epithelium is also a feature of ADPKD because cyst cells in culture produce soluble vascular endothelial growth factor (VEGF). VEGFR1 has also been detected in epithelial cells of cystic tubules but not in endothelial cells in the vasculature of cystic kidneys or normal kidneys. VEGFR2 expression is increased in endothelial cells of cyst vessels and in endothelial cells during renal ischemia-reperfusion. It is proposed that inhibition of VEGF receptors with anti-VEGFR1 and anti-VEGFR2 siRNA molecules would attenuate cyst formation, renal failure and mortality in ADPKD. Anti-VEGFR2 siRNA molecules would therefore be designed to inhibit angiogenesis involved in cyst formation. As VEGFR1 is present in cystic epithelium and not in vascular endothelium of cysts, it is proposed that anti-VEGFR1 siRNA molecules would attenuate cystic epithelial cell proliferation and apoptosis which would in turn lead to less cyst formation. Further, it is proposed that VEGF produced by cystic epithelial cells is one of the stimuli for angiogenesis as well as epithelial cell proliferation and apoptosis. The use of Han:SPRD rats (see for example Kaspareit-Rittinghausen et al., 1991, Am. J. Pathol. 139, 693-696), mice with a targeted mutation in the Pkd2 gene (Pkd2−/− mice, see for example Wu et al., 2000, Nat. Genet. 24, 75-78) and cpk mice (see for example Woo et al., 1994, Nature, 368, 750-753) all provide animal models to study the efficacy of siRNA molecules of the invention against VEGFR1 and VEGFR2 mediated renal failure.

VEGF, VEGFR1 VGFR2 and/or VEGFR3 protein levels can be measured clinically or experimentally by FACS analysis. VEGF, VEGFR1 VGFR2 and/or VEGFR3 encoded mRNA levels are assessed by Northern analysis, RNase-protection, primer extension analysis and/or quantitative RT-PCR. siRNA nucleic acids that block VEGF, VEGFR1 VGFR2 and/or VEGFR3 protein encoding mRNAs and therefore result in decreased levels of VEGF, VEGFR1 VGFR2 and/or VEGFR3 activity by more than 20% in vitro can be identified.

Respiratory Disease Models

Exaggerated levels of VEGF are present in subjects with asthma, but the role of VEGF in normal and asthmatic lungs has not been well defined. Lee et al., 2004, Nature Medicine, 10, 1095-1103, generated lung-targeted VEGF165 transgenic mice and evaluated the role of VEGF in T-helper type 2 cell (TH2)-mediated inflammation in the lungs of these animals. In these mice, VEGF induced, through IL-13-dependent and independent pathways, an asthma-like phenotype characterized by inflammation, parenchymal and vascular remodeling, edema, mucus metaplasia, myocyte hyperplasia and airway hyper-responsiveness. VEGF was also found to enhance respiratory antigen sensitization and TH2 inflammation and increased the number of activated DC2 dendritic cells in the mice. In antigen-induced inflammation, VEGF was produced predominantly by epithelial cells and preferentially by TH2 as opposed to TH1 cells. In this setting, VEGF demonstrated a critical role in TH2 inflammation, cytokine production and physiologic dysregulation. Thus, VEGF is a mediator of vascular and extravascular remodeling, inflammation, and vascular permeability/edema that enhances antigen sensitization and is crucial in adaptive TH2 inflammation. Disruption of VEGF is therefore expected to be of therapeutic significance in the treatment of asthma and other TH2 disorders. The transgenic mice described by Lee et al., 2004, Nature Medicine, 10, 1095-1103 can be used in preclinical models of asthma and other respiratory diseases that utilize treatment of such mice with siNA molecules of the invention, for example via pulmonary delivery approaches as a known in the art to evaluate the efficacy of siNA molecules in the treatment of respiratory disease. Such studies would be useful in the preclinical setting to establish parameters of use in treating human subjects.

Other animal models are useful in evaluating siNA molecules of the invention in the treatment of respiratory disease. For example, Kuperman et al., 2002, Nature Medicine, 8, 885-9, describe an animal model of IL-13 mediated asthma response animal models of allergic asthma in which blockade of IL-13 markedly inhibits allergen-induced asthma. Venkayya et al., 2002, Am J Respir Cell Mol. Biol., 26, 202-8 and Yang et al., 2001, Am J Respir Cell Mol. Biol., 25, 522-30 describe animal models of airway inflammation and airway hyperresponsiveness (AHR) in which IL-4/IL-4R and IL-13 mediate asthma. These models can be used to evaluate the efficacy of siNA molecules of the invention targeting, for example, IL-4, IL-4R, IL-13, and/or IL-13R for use is treating asthma.

Example 9

A Phase I, Open-Label, Dose Escalation Trial of a Single Intravitreal Injection of Sirna-027™ in Patients with Subfoveal Choroidal Neovascularization (CNV) Secondary to Age-Related Macular Degeneration (AMD)

A Phase I study was conducted to demonstrate the safety and tolerability of single ascending doses via intravitreal injection of Sirna-027, (Compound No. 31270/31273, Table III) and as proof of principle of biological activity of Sirna-027 in patients with CNV secondary to AMD. Preclinical findings suggest that blocking the VEGF pathway may result in meaningful responses in animal models of CNV. It is believed that the direct delivery of Sirna-027 into the vitreous humor to block the VEGF pathway may also result in clinical responses.

Sirna-027 was studied as a single agent in patients with CNV. The rationale for the doses in this Phase I trial was supported by the preclinical toxicology program, particularly from data obtained in monkeys. Sirna-027 had no significant adverse effects at doses up to 750 µg/eye. The benign preclinical safety profile, combined with the efficacy suggested by multiple rodent studies, justifies the conduct of a Phase I study in AMD patients.

Study Objectives

The Study Objectives Include:
 To assess the safety, tolerability, and dose-limiting toxicity (DLT) of a single dose of Sirna-027 when administered by intravitreal injection
 To assess the plasma concentrations of Sirna-027 following a single administration by intravitreal injection
 To determine the range of doses appropriate for use in Phase II trials of Sirna-027
 To assess anatomical changes in exudation, retinal thickening and size of CNV
 To assess changes in visual acuity Inclusion Criteria The following inclusion criteria are required for study entry:
1. Patients presenting with subfoveal CNV secondary to wet AMD as confirmed by fundus microscopy and fluorescein angiography
2. ≧50 years and in general good health. Women must be post-menopausal or otherwise not of childbearing potential.
3. Best corrected visual acuity in the study eye of equal to or worse than 20/100 but not worse than 20/800 on the ETDRS chart at 4 meters
4. Uncorrected visual acuity in fellow eye not worse than 20/800
5. Clear ocular media and adequate pupillary dilatation to permit good quality stereoscopic fundus photography
6. Subfoveal CNV (classic and/or occult CNV)
7. CNV lesion thickness ≧250 µm by OCT assessment
8. Intraocular pressure of 25 mmHg or less
9. Patients with concomitant eye disease such as controlled glaucoma (25 mmHg or less on treatment) may be enrolled
10. Patients not eligible for or who refuse standard treatment Exclusion Criteria The following will exclude a patient from entry onto the study:
1. Women of childbearing potential
2. Significant media opacities including cataract, which might interfere with visual acuity, assessment of toxicity, or fundus photography
3. Presence of other causes of CNV including pathologic myopia (spherical equivalent of −8 diopters or more), the ocular histoplasmosis syndrome, angioid streaks, choroidal rupture, and multifocal choroiditis
4. Any intraocular surgery or treatment of AMD with Visudyne, or other standard or experimental treatments, within 3 months of study entry
5. Blood occupying >50% of the lesion
6. Presence of subfoveal scarring >50% of lesion
7. CNV lesion ≧12 MPS disc area 8. Previous or concomitant therapy with another investigational agent to treat AMD (except multivitamins and trace minerals) within the last 90 days
9. Any of the following underlying systemic diseases, including uncontrolled diabetes mellitus or presence of diabetic retinopathy, cardiac disease including myocardial infarction within 12 months before study entry, coronary disease associated with clinical symptoms, stroke (within 12 months of study entry), active bleeding disorders, any major surgical procedure within 1 month of study entry, active peptic ulcer disease with bleeding within 6 months of study entry, and concomitant systemic therapy with corticosteroids (e.g. oral prednisone) or other antiangiogenic drugs (e.g. thalidomide).
10. Patients on anti-coagulant therapy. However, if the anti-coagulant can be withheld for 3-7 days prior to injection of Sirna-027, patient may be enrolled. Patient eligibility and length of time that anti-coagulant therapy is withheld must be obtained in consultation with the treating physician.

Treatments

Administration and Criteria for Dose Escalation

Cohorts of 3 patients were treated at each dose level (see below). Cohort 1 received a single intravitreal injection of Sirna-027 of 100 µg. The dose was increased for patients in subsequent cohorts according to the series of preplanned steps described below. Dose escalation for subsequent patients occurred only after sufficient time had passed to observe any acute toxic effects for patients treated at lower doses. Patients in subsequent cohorts received a single intravitreal injection of Sirna-027 at the next planned higher dose only after review of patient data through Study Day 14 of the cohort.

If no DLT was seen at a dose level then the dose can be escalated for the next cohort, or at the Investigator's option and by agreement with the Sponsor, additional patients may be treated at the current dose If a DLT was seen in one patient in the 3-patient dose cohort, then three more patients would be treated at the same dose level. If no further cases of DLT are seen in these additional patients, then the dose level would escalated for the next cohort. Otherwise dose escalation was stopped.

If 2 or more patients in the 3-patient dose cohort have a DLT, then dose escalation will stop If DLTs are seen, at the Investigators' option and by agreement with the Sponsor, additional patients may be treated at current, lower, or intermediate doses Planned and potential dose levels

| Planned or Potential Dose | Cohort | Dose |
|---|---|---|
| Planned | 1 | 100 µg |
| Planned | 2 | 200 µg |
| Planned | 3 | 400 µg |
| Planned | 4 | 800 µg |
| Potential | 5 | 1200 µg |
| Potential | 6 | 1800 µg |

Safety margin for clinical doses based on the NOAEL in monkey

| Planned or Potential Dose | Single-Dose NOAEL in Monkey Eye[1] | | Clinical Dose[2] | | Safety Margin (ratio) |
|---|---|---|---|---|---|
| | Dose | Monkey Vitreal Concentration | Dose | Human Vitreal Concentration | |
| Planned | 750 µg | 234 µg/mL | 100 µg | 25 µg/mL | 9.4[3] |
| Planned | 750 µg | 234 µg/mL | 200 µg | 50 µg/mL | 4.7 |
| Planned | 750 µg | 234 µg/mL | 400 µg | 100 µg/mL | 2.3 |
| Planned | 750 µg | 234 µg/mL | 800 µg | 200 µg/mL | 1.2 |
| Potential | 750 µg | 234 µg/mL | 1200 µg | 300 µg/mL | 0.8 |
| Potential | 750 µg | 234 µg/mL | 1800 µg | 450 µg/mL | 0.5 |

[1]750 µg in 3.2 mL vitreous volume (monkey) = 234 µg/mL
[2]Human vitreous volume of 4.0 mL was used
[3]Reported as 9.2 in Error! Reference source not found. and in the IDB as a result of rounding differences when mg vs µg are used List of Potential DLT(s) Observed at Day 14 Visit An ophthalmic DLT is defined as any toxicity (AE or SAE) determined by the Investigator to be related to the study drug and of such intensity or severity to preclude dose escalation.

By Clinical Examination:
  Formation of cataract as judged by Investigator to be secondary to the injection of study drug.
  Severe clinically significant inflammation that obscures visualization of the retinal vasculature and/or threatens the patient's vision.
  Other ocular abnormalities not usually seen in patients with AMD, such as retinal, arterial, or venous occlusion, acute retinal detachment, and diffuse retinal hemorrhage.
  Visual acuity: doubling or worsening of the visual angle (loss of ≧15 letters), unless the loss of vision is due to a vitreous hemorrhage related to the injection procedure.
  Tonometry: increase from baseline of intraocular pressure by ≧25 mmHg on two separate examinations at least 1 day apart or a sustained pressure of 30 mmHg for more than a week despite pharmacologic intervention.

By Fluorescein Angiogram:
  Significant retinal or choroidal vascular abnormalities not seen at baseline, such as:
  Choroidal non-perfusion (affecting one or more quadrants)
  Delay in arteriovenous transit times (>15 seconds)
  Retinal arterial or venous occlusion (any deviation from baseline)
  Diffuse retinal permeability alteration affecting retinal circulation in the absence of intraocular inflammation
  Systemic DLT(s) to include Grade III (severe) or IV (life-threatening) toxicities or any significant severe toxicity deemed related to study drug by the Investigator.

Identity of Investigational Product

Sirna-027 was manufactured by Sirna Therapeutics. The drug product was supplied in 5 mL glass vials that were stored frozen, −25 to −15° C. (−13 to +5° F.). The drug storage area was secure and have limited access. Labeled drug was shipped to the site by the Sponsor or an approved vendor once the necessary regulatory documents were received from the site.

Stability studies to support drug storage under these conditions were conducted by the Sponsor. The Sponsor will continue to monitor the stability and alert the site if a lot needs to be replaced for stability reasons. A Material Safety Data Sheet was provided for Sirna-027.

Sample label text for the drug product is shown below.

| Sirna-027 ™ | 5 mg Lyophilized Powder |
|---|---|
| Lot # xxxxxx | Single use vial |
| Store frozen, −25 to −15° C. (−13 to +5° F.) | |
| CAUTION: New Drug - Limited by Federal law to investigational use. | |
| Sirna Therapeutics, Inc., Boulder, CO USA | |

Reconstitution for Dosing

Sirna-027 was supplied as a 5 mg lyophilized powder in a 5 mL vial. A phosphate buffered saline solution supplied by Sirna was added to each vial to reconstitute to the appropriate concentration for each dose level. Injection volume was 100 µL for all doses.

Reconstitution schema

| Dose Group | Clinical Dose | Phosphate Buffered Saline Solution (to add to vial) |
|---|---|---|
| Cohort 1 | 100 µg | 5.0 mL |
| Cohort 2 | 200 µg | 2.5 mL |
| Cohort 3 | 400 µg | 1.25 mL |
| Cohort 4 | 800 µg | 0.625 mL |
| Cohort 5 | 1200 µg | 0.417 mL |
| Cohort 6 | 1800 µg | 0.277 mL |

Method for Assigning Patients to the Treatment Group

Patient numbers were assigned sequentially by site. The first two numbers of the five-digit patient number identify the site and the last three numbers were assigned sequentially to the patients being placed on the study.

Selection of Doses in the Study

The starting dose was chosen to be approximately one-tenth of the NOAEL seen in the single dose monkey toxicity study. Dose escalation was based on a doubling of the planned doses up to 800 µg, and 50% incremental increase if additional patients receive doses above 800 µg. Planned dosing was in 4 cohorts of 3 patients each. Impact of possible DLT on dose selection is given above.

Administration of Sirna-027

Procedures were implemented to minimize the risk of potential adverse events associated with intraocular injection (e.g., retinal detachment and endophthalmitis). Aseptic technique was observed by clinic staff involved in the injection tray assembly, anesthetic preparation and administration, and study drug preparation and administration. In addition to the procedures outlined in the protocol, added safety measures in adherence to specific institutional policies associated with intraocular injections were observed, including a complete ophthalmic surgical prep and drape.

Sirna-027 was administered in the study eye only. Following the slit-lamp examination, intravitreal injection of Sirna-027 was performed by a qualified ophthalmologist in either a surgical suite or an appropriately equipped procedure room. The patient was placed in a supine position on a surgical bed or examination chair. After thorough cleansing of the lid, lashes, and periorbital area with an antiseptic, a lid speculum was inserted. Local anesthesia and topical antimicrobials were administered prior to study drug injection.

A 30-gauge, ½-inch needle, attached to a low-volume (e.g., tuberculin) syringe containing 100 µL of various concentrations of Sirna-027 was inserted through the pre-anesthetized conjunctiva and sclera, approximately 3.5-4.0 mm posterior to the limbus, avoiding the horizontal meridian and aiming toward the center of the globe. The injection volume was delivered slowly. The needle was then be removed slowly to ensure that all drug solution remained in the eye.

Following the intraocular injection, the patients remained at the study site for at least 4 hours. Indirect ophthalmoscopy was performed to determine status of optic nerve perfusion and presence of any retinal pathology such as hemorrhage or tear. Intraocular pressure was measured before and 30 minutes after the Sirna-027 injection. Any patient who developed significantly raised intraocular pressure ($\geq$28 mmHg) at any time during the study was monitored and managed (i.e. paracentesis) according to the physician's clinical judgment and could undergo additional measurements of intraocular pressure beyond those specified in the protocol. If there were no safety concerns in the 4 hours following the injection, the patient could leave the clinic. If any concern or immediate toxicity is noted, the patient would remain at the clinic and would be treated according to the physician's clinical judgment. Patients returned the day after the injection to be evaluated for change in vision, measurement of intraocular pressure, and assessment of eye pain, unusual redness, or any other new ocular symptoms. At any time during the study, if it was determined necessary by the evaluating physician, the patient was asked to return to the clinic as soon as possible for an unscheduled study visit and was evaluated by the ophthalmologist. Patients were instructed to contact their physician at any time should they have health-related concerns.

In addition, antimicrobial drops for the eye (i.e. ofloxacin) were administered immediately after the intravitreal injection, and the patient was instructed to self-administer antimicrobial drops four times daily for 3 days following the intraocular injection of Sirna-027.

Concomitant Medications

Patients already taking multivitamins and trace minerals for AMD could continue these treatments. Patients could not begin these therapies during the first 84 days of this trial. Patients were allowed to continue topical medications for other existing conditions (i.e. glaucoma drops). Subsequent to the injection of Sirna-027, patients were instructed to use topical antibiotics eye drops for three days.

Treatment Compliance

This was a single injection administered by the Investigators at the study sites.

Study Procedures

The various assessments that were conducted during this study are described in this section in narrative form, listed by study visit, and in tabular form (see below).

A complete ophthalmic evaluation with fundus photography, fluorescein angiography, OCT, and Visual Acuity Test was performed prior to study start and at the Study Day 7, 14, 28, and 84. An eye exam including visual acuity, tonometry, slit lamp biomicroscopy and OCT was performed at Study Day 56. A streamlined physical examination (heart, lungs, abdomen, neurology) was performed prior to study start was repeated at Study Day 84 or in case of premature termination from the study.

Patients were monitored for adverse events (AEs) through Study Day 84. Adverse events beginning within this evaluation period (84 days) of this study were followed to resolution. Patients are monitored for serious adverse events (SAEs) through month 24.

Patient safety follow-up consists of routine eye examinations at 6, 9, 12, 18 and 24 months following injection. At these visits patient will be queried regarding any untoward events related to their eye health.

It was anticipated that patients would not need additional medical treatment for AMD during the 84 days of the study evaluation period. During the safety follow-up period (months 3 to 24), patients are allowed to receive medically-indicated treatment (i.e. PDT, laser photocoagulation) as deemed necessary by the evolution of the disease and by the judgment of the treating physician.

Screening Evaluations

Within Two Weeks of the Day 1 Visit
  Signed informed consent (informed consent must be obtained prior to performance of any study specific tests or evaluations)
  Complete ophthalmic examination (to include visual acuity assessment, slit lamp biomicroscopy-evaluation of lashes, lids, conjunctivae, cornea, anterior chamber, iris, lens, vitreous, and the performance of tonometry, fundus photography, FA and OCT)
  Assess eligibility—confirmation of eligibility to be determined by review of fundus photography, fluorescein angiography and OCT by the Wilmer Retinal Imaging Research and Reading Center
  Demographics
  Streamlined physical exam (heart, lungs, abdomen, neurology)
  Vital signs
  Medical history
  Clinical labs Evaluations Baseline/Day 1
  Medical History Update (prior to injection)
  Vital signs (prior to injection)
  Visual acuity test (prior to injection)
  Tonometry (prior to injection)
  Adverse events (including injection to 4 hours post-injection)
  PK blood draws will be done prior to the intravitreal injection of Sirna-027 and at hours 1 and 4 following the injection
  Administer Sirna-027 intravitreal injection, observe patient for 4 hours after injection. (Patient's study eye will be examined at 30 minutes post injection to ensure adequate ocular perfusion and normal intraocular pressure. If pressure exceeds 28 mmHg, the physician may choose to perform a post-injection paracentesis.)

Day 2
  Vital signs, adverse event and concomitant medication assessment
  Eye examination to include visual acuity, tonometry, slit lamp biomicroscopy, and assessment of eye pain, unusual redness, or other new ocular symptoms
  PK blood draw (24 hours post administration)

Day 7
  Vital signs, adverse event and concomitant medication assessment
  PK blood draw
  Complete ophthalmic examination Day 14
  Vital signs, adverse event and concomitant medication assessment
  Complete ophthalmic examination Day 28
  Vital signs, adverse events and concomitant medication assessment
  Complete ophthalmic examination Day 56
  Vital signs, adverse events and concomitant medication assessment
  Eye examination to include visual acuity, tonometry, slit lamp biomicroscopy and OCT Day 84/Early Termination Visit (Prior to Day 84)
  Streamlined physical exam (heart, lungs, abdomen, neurology)
  Vital signs, adverse events and concomitant medication assessment
  Clinical labs
  Complete ophthalmic examination Follow-Up Visit-Month 6
  Routine eye exam (to include visual acuity assessment, slit lamp biomicroscopy—evaluation of lashes, lids, conjunctivae, cornea, anterior chamber, iris, lens, vitreous, applanation tonometry and dilated fundus examination) and fundus photography.

Follow-Up Visit-Month 9
  Routine eye exam

Follow-Up Visit-Month 12
  Routine eye exam and fundus photography

Follow-Up Visit-Month 18
  Routine eye exam and fundus photography

Follow-Up Visit-Month 24
  Routine eye exam and fundus photography

Schedule of procedures/assessments

| PROCEDURES | Screen | Baseline/Day 1 | Day 2 | Day 7[1] | Day 14[2] | Day 28[2] | Day 56[2] | Day 84/Early Term.[2] | Follow-up Month 6 | Follow-up Month 9 | Follow-up Month 12 | Follow-up Month 18 | Follow-up Month 24 |
|---|---|---|---|---|---|---|---|---|---|---|---|---|---|
| Administer Intravitreal Injection of Sirna-027 | | X | | | | | | | | | | | |
| Sign Informed Consent | X | | | | | | | | | | | | |
| Assess Eligibility | X | | | | | | | | | | | | |
| Demographics | X | | | | | | | | | | | | |

Schedule of procedures/assessments

| PROCEDURES | Screen | Baseline/ Day 1 | Day 2 | Day 7[1] | Day 14[2] | Day 28[2] | Day 56[2] | Day 84/ Early Term.[2] | Follow-up Month 6 | Follow-up Month 9 | Follow-up Month 12 | Follow-up Month 18 | Follow-up Month 24 |
|---|---|---|---|---|---|---|---|---|---|---|---|---|---|
| Physical Exam | X | | | | | | | X | | | | | |
| Vital Signs | X | X | X | X | X | X | X | X | | | | | |
| Concomitant Meds | | | X | X | X | X | X | X | | | | | |
| Adverse Event | | X | X | X | X | X | X | X | | | | | |
| Medical History | X | X | | | | | | | | | | | |
| Clinical Labs | X | | | | | | | X | | | | | |
| Visual Acuity Test | X | X | X | X | X | X | X | X | X | X | X | X | X |
| Tonometry | X | X | X | X | X | X | X | X | X | X | X | X | X |
| Complete ophthalmic examination[3] | X | | | X | X | X | | X | | | | | |
| Slit lamp biomicroscopy | | | X | | | | X | | | | | | |
| Routine Eye Exam[4] | | | | | | | | | X[5] | X | X[5] | X[5] | X[3] |
| OCT | | | | | | | X | | | | | | |
| PK Blood Draws | | X[6] | | X[7] | X | | | | | | | | |

[1] ±1 day
[2] ±2 days
[3] Includes visual acuity assessment, slit lamp biomicroscopy (evaluation of lashes, lids, conjunctivae, cornea, anterior chamber, iris, lens, vitreous), and the performance of tonometry, fundus photography, FA and OCT.
[4] Includes visual acuity assessment, slit lamp biomicroscopy (evaluation of lashes, lids, conjunctivae, cornea, anterior chamber, iris, lens, vitreous), applanation tonometry and dilated fundus examination.
[5] Plus fundus photography
[6] Pre-injection, 1 and 4 hours post-injection
[7] 24 hours post-injection Safety Assessments Adverse Events (AEs)

It is the responsibility of the Investigator to document all AEs that occur after the patient receives their single dose of Sirna-027. An AE includes any noxious, pathological, or unintended change in anatomical, physiological, or metabolic functions as indicated by physical signs, symptoms, and/or laboratory changes occurring in any phase of the clinical study after the single administration of study drug whether associated with the study drug and whether or not considered drug related. This includes an exacerbation of pre-existing medical conditions or events, intercurrent illnesses, nonallergic reactions, drug interactions, or the significant worsening of the disease under investigation (AMD). Anticipated day-to-day fluctuations of pre-existing conditions that do not represent a clinically significant exacerbation or worsening need not be considered AEs.

An AE is considered to be associated with the use of the study drug if the relationship between the AE and the drug is classified by the Investigator as "possibly related" or "probably related." An unexpected AE is any adverse drug experience that is not consistent with the specificity or severity as stated in the current Investigational Drug Brochure.

Assessment of Severity

Intensity should be assigned using severity grades as outlined in the Case Report Form Booklets (to be provided separately).

Assessment of Causality

The degree of certainty with which an AE is attributed to drug treatment (or alternative causes, e.g., natural history of the underlying diseases, concomitant therapy, etc.) will be determined by how well the event can be understood in terms of one or more of the following:

Known pharmacology of the investigational drug
Reaction of similar nature being previously observed with the investigational drug or the class of drug
The event having been often reported in literature for a similar drug as drug related (e.g., skin rashes, and blood dyscrasia)
The event being temporally related to study drug exposure, including termination of the event after study drug withdrawal (dechallenge) or recurrence on rechallenge with study drug Every effort should be made by the Investigator to explain each AE and assess its relationship, if any, to study drug treatment. Due to the nature of the intravitreal injection, an AE or SAE may be related to the procedure, but not to the study drug. Judgment of relatedness to procedure or study drug will be at the discretion of the Investigator. Causality should be assessed using the following categories: not related, possibly related, probably related, and related. The definitions of these categories are:

Not Related:

If there is no exposure to investigational drug, then, the AE is not related; OR, the occurrence of the AE is not reasonably related in time, and may be due to other factors such as an intercurrent illness, concomitant medication, or underlying disease state Possibly Related:

The administration of the investigational drug and AE are considered reasonably related in time AND the AE could be explained by causes other than exposure to the investigational drug Probably Related:

Exposure to the investigational drug and AE are reasonably related in time AND the investigational drug is more likely than other causes to be responsible for the AE, OR is the most likely cause of the AE Related:

A reaction from administration of the investigational drug that follows a known response pattern to the suspected investigational drug and can be confirmed with a positive re-challenge test or supporting laboratory data Follow up of Adverse Events Investigators should follow up patients with AEs until one of the following:
The event has subsided or disappeared
The condition has stabilized
The event is otherwise resolved
The patient is lost to follow-up
The study ends AEs not resolved at Study Day 84 will be followed to resolution. After Study Day 84, only AEs qualifying as serious (SAEs) will be captured and followed. Beyond Study Day 84, patient safety follow-up will consist of the routine ophthalmic evaluation at Months 6, 9, 12, 18 and 24. If, during the follow-up period, a patient requires medically-indicated ocular treatment, e.g. PDT or laser coagulation, then the patient will be considered to have completed his/her participation in this study and no further follow-up will be done.

Pregnancies

Pregnancies are not considered to be AEs or SAEs; however, pregnancies will be followed through outcome. In pregnancies that progress to term, any congenital abnormalities in the offspring of a patient who received study drug should be reported as an SAE.

Serious Adverse Events

Definition of a Serious Adverse Events:
A serious adverse event is defined as any untoward medical occurrence that at any dose:
Results in death
Is life threatening (i.e., the patient was, in the opinion of the Investigator, at immediate risk of death from the event as it occurred)
Requires or prolongs inpatient hospitalization
Results in persistent or significant disability/incapacity, (i.e., the event causes a substantial disruption of a person's ability to conduct normal life functions)
Is a congenital anomaly/birth defect
Is an important and significant medical event that, based upon appropriate medical judgment, may jeopardize the patient or may require medical or surgical intervention to prevent one of the other outcomes defining serious Reporting Serious Adverse Experiences The Investigator must report any SAEs that occur from study entry through end of study follow-up (Month 24), whether or not considered related to the study drug, to Sponsor by fax within 24 hours. If, during the follow-up period, a patient requires medically indicated ocular treatment, e.g. PDT or laser coagulation, then the patient will be considered to have completed his/her participation in this study and no further reporting of SAEs is required. Specific reporting information and forms are found in the Clinical Study Binder.

Investigators should not wait to receive additional information to fully document the event before notifying Sirna Therapeutics of an SAE. A full written summary detailing relevant aspects of the SAEs should follow the fax report in question. Where applicable, information from relevant hospital case records and autopsy reports should be obtained. The SAE should be recorded on the AE page of the patient's case report form (CRF).

Any deaths that occur between the date of the administration of Sirna-027 through the Month 24 visit are to be reported as SAEs.

The Investigator is responsible for informing his/her Institutional Review Board/Institutional Ethics Committee (IRB/IEC) as soon as possible, but in no event later than 15 working days after the discovery of death from any cause, or SAEs, or problems of medical significance that may reasonably be regarded as caused by or associated with the study drug.

Study Outcome

Twenty-three patients have been enrolled and dosed in Cohorts 1 through 6 (100 µg-1600 µg). Patient demographics are shown below. Seven of the patients were enrolled at the Cole Eye Institute and the other sixteen were enrolled at the Wilmer Eye Institute.

| Sirna 0401 Patient Demographics | | | |
|---|---|---|---|
| Dose Cohort | Patient | Gender | Age |
| 100 µg | 03-001 | F | 78 |
| | 01-001 | F | 93 |
| | 03-002 | F | 84 |
| | 01-002 | M | 83 |
| 200 µg | 01-003 | F | 75 |
| | 01-004 | M | 82 |
| | 01-005 | M | 68 |
| 400 µg | 01-006 | F | 89 |
| | 01-007 | M | 85 |
| | 01-008 | F | 85 |
| 800 µg | 01-009 | M | 77 |
| | 01-010 | F | 70 |
| | 03-003 | F | 87 |
| | 03-004 | M | 81 |
| | 01-011 | F | 76 |
| | 01-012 | F | 82 |
| 1200 µg | 01-013 | F | 87 |
| | 01-014 | F | 84 |
| | 03-005 | F | 82 |
| | 03-006 | F | 80 |
| | 01-015 | F | 81 |
| | 01-016 | M | 84 |
| 1600 µg | 03-008 | F | 85 |

Safety

There have been no dose limiting toxicities or safety issues to date with any of the 23 patients. Of the adverse events recorded, all but one (a moderate case of diarrhea not related to the study drug) have been considered mild. They were all reversible and none have been definitively attributed to the drug.

Effect on Visual Acuity (VA)

Preliminary review of data on the effect of Sirna-027 on VA for 22 patients was conducted which demonstrated stabilization of VA in all patients, a variable mean increase of number of letters read for each dose group, and a duration of effect sustained over 8 weeks post-injection (FIG. 30). At the same assessment point of 8 weeks, VA (number of lines read) was stable or improved in 100% of the patients, while a clinically significant improvement (equal to or more than 3 lines) was observed in 23% of patients (FIG. 31).

OCT Results

Preliminary data on central foveal thickness for the first four dose groups (100, 200, 400 and 800 µg) showed a decrease of the lesion thickness for the 100, 200 and 800 μg doses, with maximum effect by 14 days post-injection (FIG. 32).

Example 10

A Phase IIa, Multi-Center, Randomized, Masked, Sham- or Positive Controlled, Dose Finding Trial of Multiple Intravitreal Injections of Sirna-027™ in Patients with Subfoveal Choroidal Neovascularization (CNV Secondary to Age-Related Macular Degeneration (AMD)

This study is a Phase IIa multicenter study consisting of 112-day investigational period following 3 injections of Sirna-027 with a follow-up for a total of 24 months. The primary objectives of the study are:

To assess the safety, tolerability, and dose-limiting toxicity (DLT) of multiple doses of Sirna-027 when administered by multiple intravitreal injections.

To determine dose appropriate for use in confirmatory Phase IIb/III trials of Sirna-027 based on changes in visual acuity, and anatomical changes in exudation, retinal thickening and size of CNV in a sub-population of patients.

To assess the plasma concentrations of Sirna-027 following administration of multiple intravitreal injections.

The methodolgy of the study consists of:

Masked, sham-controlled, (or positive-control) randomized, dose-finding trial.

All patients will receive 3 intravitreal injection of Sirna-027 or 3 sham procedures (or positive control) at 4, 6, or 8-week intervals.

Patients will be enrolled in 4 dose-cohorts of 30 evaluable patients each (120 patients total). Treatment in each dose cohort will consist of either 3 sham-procedures (or 3 injection of positive control), or 3 injections of Sirna-027 (both masked to the patient). Enrollment into these 4 dose-cohorts will be by a centralized randomization. The 3 dose levels of Sirna-027 will be the MTD established in Phase I and two lower doses.

Patient's blood will be assayed for Sirna-027 at Baseline/Study Day 1 (prior to injection, hours 1 and 4 following injection), Study Day 2 (24 hours following injection), Study Day 7, and Study Day 56 following the 3rd injection.

Patient's visual acuity will be measured beginning at a distance of 4 meters using the Early Treatment Diabetic Retinopathy Study (ETDRS) chart at every study visit.

Patient's study eye will be examined (fundus and tonometry) at 30 minutes post injection to ensure adequate ocular perfusion and normal intraocular pressure. If pressure exceeds 28 mmHg, the patient will be re-examined at 60 minutes. If the pressure still exceeds 28 mmHg, the physician may choose to perform a post-injection paracentesis. Patients will be observed for 4 hours following the first injection. Remaining injections 2 and 3 require the 30 and 60 minute post injections examination, but will not require the extended 4 hour observation period.

Patients will receive an eye exam including visual acuity, tonometry, slit lamp biomicroscopy and a complete ophthalmic evaluation, and fundus photography, at screening/baseline and at Study Days 7, 14, 28, 56, 84, and 112 Patients will receive a routine eye exam at the safety follow-up visits at months 6, 9, 12, 18 and 24.

Fundus photography, OCT, and fluorescein angiography evaluations will be done by an independent reading center on a sub-population of patients.

Opthalmic Inclusion Criteria for the Study Include:

Subfoveal CNV (classic and/or occult), secondary to AMD as confirmed by fundus microscopy and fluorescein angiography, with a total lesion size (including blood, scar/atrophy and neovascularization) of $\leq 12$ MPS disc areas, of which at least 50% has to be active CNV.

BCVA in the study eye between 20/80 and 20/400, and better than or equal to 20/800 in the fellow eye.

Clear ocular media and adequate papiliary dilatation to permit good quality stereoscopic fundus photography.

Subretinal hemorrhage less than 50% of total lesion size.

CNV lesion thickness $\geq 250$ μm by OCT assessment.

Intraocular pressure of 25 mmHg or less

Patients with concomitant eye disease such as controlled glaucoma (25 mmHg or less on treatment) may be enrolled.

Patients not eligible for or who refuse standard treatment.

General Inclusion Criteria for the Study Include:

$\geq 50$ years and in general good health. Women must be post-menopausal or otherwise not of childbearing potential.

Written informed consent.

The ability to return for all study visits.

Exclusion Criteria for the Study Include:

Women of childbearing potential

Significant media opacities including cataract, which might interfere with visual acuity, assessment of toxicity, or fundus photography Presence of other causes of CNV including pathologic myopia (spherical equivalent of −8 diopters or more), the ocular histoplasmosis syndrome, angioid streaks, choroidal rupture, and multifocal choroiditis Any intraocular surgery or treatment of AMD with Visudyne, Macugen, or other standard or experimental treatments, within 3 months of study entry Blood occupying >50% of the lesion Presence of subfoveal scarring >50% of lesion CNV lesion $\geq 12$ MPS disc area Previous or concomitant therapy with another investigational agent to treat AMD (except multivitamins and trace minerals) within the last 90 days Any of the following underlying systemic diseases:
  Uncontrolled diabetes mellitus
  Diabetic retinopathy
  Cardiac disease including myocardial infarction within 12 months before study entry
  Coronary disease associated with clinical symptoms
  Stroke (within 12 months of study entry)
  Active bleeding disorders
  Any major surgical procedure within 1 month of study entry
  Active peptic ulcer disease with bleeding within 6 months of study entry
  Concomitant systemic therapy with corticosteroids (e.g. oral prednisone) or other antiangiogenic drugs (e.g. thalidomide).

If patient is on anti-coagulant therapy, the anti-coagulant may be withheld for 3-7 days prior to each injection of Sirna-027. Patient eligibility and length of time that anti-coagulant therapy is withheld must be obtained in consultation with the treating physician.

Test Product: Sirna-027 will be supplied as a lyophilized powder in a vial. A phosphate buffered solution will be added to each vial to reconstitute to the appropriate concentration for each dose level. Injection volume will be 100 μL Duration of Treatment: Treatment with Sirna-027 is 3 intravitreal injections at 4, 6, or 8-week intervals. Patients will be followed for 24 months from the date of the first injection.

Criteria for Evaluation: For safety evaluation, the incidence of serious and other adverse events will be determined along with pharmacokinetic analysis to test for the accumulation of drug after 3 injections. For determination of efficacy and dose selection, changes in visual acuity as measured by performance on the ETDRS chart beginning at 4 meters will be determined as well as changes in CNV size, exudation, retinal thickness/elevation at any time following administration of Sirna-027 as measured by fundus photography, fluorescein angiography, and OCT in a sub-population of patients.

Statistical Methods: Serious and other adverse events will be reported as the number of patients experiencing an event (incidence) and by probable relatedness to the drug and/or the injection procedure. These events will be classified according to the MedDRA medical dictionary and presented by dose cohort. Results from the fundus photography, fluorescein angiography and OCT will be analyzed by masked readers in a central reading center. Individual and average changes in CNV size, exudation, and retinal thickness/elevation will be displayed by dose cohort. Changes in visual acuity scores (ETDRS) post administration of multiple injections of Sirna-027 will be presented by dose. Appropriate algorithms will be used to select the dose for study in Phase III. Lastly, any association of changes in visual acuity and changes in exudation, CNV size, and/or retinal thickness will be described.

Example 11

Indications

The present body of knowledge in VEGF and/or VEGFR research indicates the need for methods to assay VEGF and/or VEGFR activity and for compounds that can regulate VEGF and/or VEGFR expression for research, diagnostic, and therapeutic use. As described herein, the nucleic acid molecules of the present invention can be used in assays to diagnose disease state related of VEGF and/or VEGFR levels. In addition, the nucleic acid molecules can be used to treat disease state related to VEGF and/or VEGFR levels.

Particular conditions and disease states that can be associated with VEGF and/or VEGFR expression modulation include, but are not limited to:

1) Tumor angiogenesis: Angiogenesis has been shown to be necessary for tumors to grow into pathological size (Folkman, 1971, *PNAS* 76, 5217-5221; Wellstein & Czubayko, 1996, *Breast Cancer Res and Treatment* 38, 109-119). In addition, it allows tumor cells to travel through the circulatory system during metastasis. Increased levels of gene expression of a number of angiogenic factors such as vascular endothelial growth factor (VEGF) have been reported in vascularized and edema-associated brain tumors (Berkman et al., 1993 *J. Clini. Invest.* 91, 153). A more direct demostration of the role of VEGF in tumor angiogenesis was demonstrated by Jim Kim et al., 1993 *Nature* 362,841 wherein, monoclonal antibodies against VEGF were successfully used to inhibit the growth of rhabdomyosarcoma, glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576). Specific tumor/cancer types that can be targeted using the nucleic acid molecules of the invention include but are not limited to the tumor/cancer types described herein.

2) Ocular diseases: Neovascularization has been shown to cause or exacerbate ocular diseases including, but not limited to, macular degeneration, including age related macular degeneration (AMD), dry AMD, wet AMD, predominantly classic AMD (PD AMD), minimally classic AMD (MC AMD), and occult AMD; neovascular glaucoma, diabetic retinopathy, including diabetic macular edema (DME) and proliferative diabetic retinopathy; myopic degeneration, uveitis, and trachoma (Norrby, 1997, *APMIS* 105, 417-437). Aiello et al., 1994 *New Engl. J. Med.* 331, 1480, showed that the ocular fluid of a majority of patients suffering from diabetic retinopathy and other retinal disorders contains a high concentration of VEGF. Miller et al., 1994 *Am. J. Pathol.* 145, 574, reported elevated levels of VEGF mRNA in patients suffering from retinal ischemia. These observations support a direct role for VEGF in ocular diseases. Other factors, including those that stimulate VEGF synthesis, may also contribute to these indications.

3) Dermatological Disorders: Many indications have been identified which may beangiogenesis dependent, including but not limited to, psoriasis, verruca vulgaris, angiofibroma of tuberous sclerosis, pot-wine stains, Sturge Weber syndrome, Kippel-Trenaunay-Weber syndrome, and Osler-Weber-Rendu syndrome (Norrby, supra). Intradermal injection of the angiogenic factor b-FGF demonstrated angiogenesis in nude mice (Weckbecker et al., 1992, *Angiogenesis: Key principles-Science-Technology-Medicine*, ed R. Steiner). Detmar et al., 1994 *J. Exp. Med.* 180, 1141 reported that VEGF and its receptors were over-expressed in psoriatic skin and psoriatic dermal microvessels, suggesting that VEGF plays a significant role in psoriasis.

4) Rheumatoid arthritis: Immunohistochemistry and in situ hybridization studies on tissues from the joints of patients suffering from rheumatoid arthritis show an increased level of VEGF and its receptors (Fava et al., 1994 *J. Exp. Med.* 180, 341). Additionally, Koch et al., 1994 *J. Immunol.* 152, 4149, found that VEGF-specific antibodies were able to significantly reduce the mitogenic activity of synovial tissues from patients suffering from rheumatoid arthritis. These observations support a direct role for VEGF in rheumatoid arthritis. Other angiogenic factors including those of the present invention may also be involved in arthritis.

5) Endometriosis: Various studies indicate that VEGF is directly implicated in endometriosis. In one study, VEGF concentrations measured by ELISA in peritoneal fluid were found to be significantly higher in women with endometriosis than in women without endometriosis (24.1±15 ng/ml vs 13.3±7.2 ng/ml in normals). In patients with endometriosis, higher concentrations of VEGF were detected in the proliferative phase of the menstrual cycle (33±13 ng/ml) compared to the secretory phase (10.7±5 ng/ml). The cyclic variation was not noted in fluid from normal patients (McLaren et al., 1996, *Human Reprod.* 11, 220-223). In another study, women with moderate to severe endometriosis had significantly higher concentrations of peritoneal fluid VEGF than women without endometriosis. There was a positive correlation between the severity of endometriosis and the concentration of VEGF in peritoneal fluid. In human endometrial biopsies, VEGF expression increased relative to the early proliferative phase approximately 1.6-, 2-, and 3.6-fold in midproliferative, late proliferative, and secretory endometrium (Shifren et al., 1996, *J. Clin. Endocrinol. Metab.* 81, 3112-3118). In a third study, VEGF-positive staining of human ectopic endometrium was shown to be localized to macrophages (double immunofluorescent staining with CD14 marker).

Peritoneal fluid macrophages demonstrated VEGF staining in women with and without endometriosis. However, increased activation of macrophages (acid phosphates activity) was demonstrated in fluid from women with endometriosis compared with controls. Peritoneal fluid macrophage conditioned media from patients with endometriosis resulted in significantly increased cell proliferation ([$^3$H] thymidine incorporation) in HUVEC cells compared to controls. The percentage of peritoneal fluid macrophages with VEGFR2 mRNA was higher during the secretory phase, and significantly higher in fluid from women with endometriosis (80±15%) compared with controls (32±20%). Flt-mRNA was detected in peritoneal fluid macrophages from women with and without endometriosis, but there was no difference between the groups or any evidence of cyclic dependence (McLaren et al., 1996, J. Clin. Invest. 98, 482-489). In the early proliferative phase of the menstrual cycle, VEGF has been found to be expressed in secretory columnar epithelium (estrogen-responsive) lining both the oviducts and the uterus in female mice. During the secretory phase, VEGF expression was shown to have shifted to the underlying stroma composing the functional endometrium. In addition to examining the endometium, neovascularization of ovarian follicles and the corpus luteum, as well as angiogenesis in embryonic implantation sites have been analyzed. For these processes, VEGF was expressed in spatial and temporal proximity to forming vasculature (Shweiki et al., 1993, J. Clin. Invest. 91, 2235-2243).

6) Kidney disease: Autosomal dominant polycystic kidney disease (ADPKD) is the most common life threatening hereditary disease in the USA. It affects about 1:400 to 1:1000 people and approximately 50% of people with ADPKD develop renal failure. ADPKD accounts for about 5-10% of end-stage renal failure in the USA, requiring dialysis and renal transplantation. Angiogenesis is implicated in the progression of ADPKD for growth of cyst cells, as well as increased vascular permeability promoting fluid secretion into cysts. Proliferation of cystic epithelium is a feature of ADPKD because cyst cells in culture produce soluble vascular endothelial growth factor (VEGF). VEGFR1 has been detected in epithelial cells of cystic tubules but not in endothelial cells in the vasculature of cystic kidneys or normal kidneys. VEGFR2 expression is increased in endothelial cells of cyst vessels and in endothelial cells during renal ischemia-reperfusion.

7) Respiratory/Inflammatory Disease: Exaggerated levels of VEGF are present in subjects with asthma, but the role of VEGF in normal and asthmatic lungs has not been well defined. Lee et al., 2004, Nature Medicine, 10, 1095-1103, generated lung-targeted VEGF165 transgenic mice and evaluated the role of VEGF in T-helper type 2 cell (TH2)-mediated inflammation in the lungs of these animals. In these mice, VEGF induced, through IL-13-dependent and independent pathways, an asthma-like phenotype characterized by inflammation, parenchymal and vascular remodeling, edema, mucus metaplasia, myocyte hyperplasia and airway hyper-responsiveness. VEGF was also found to enhance respiratory antigen sensitization and TH2 inflammation and increased the number of activated DC2 dendritic cells in the mice. In antigen-induced inflammation, VEGF was produced predominantly by epithelial cells and preferentially by TH2 as opposed to TH1 cells. In this setting, VEGF demonstrated a critical role in TH2 inflammation, cytokine production and physiologic dysregulation. Thus, VEGF is a mediator of vascular and extravascular remodeling, inflammation, and vascular permeability/edema that enhances antigen sensitization and is crucial in adaptive TH2 inflammation. Disruption of VEGF is therefore expected to be of therapeutic significance in the treatment of asthma and other TH2 disorders including allergic rhinitis, COPD, and airway sensitization/inflammation.

The use of radiation treatments and chemotherapeutics, such as Gemcytabine and cyclophosphamide, are non-limiting examples of chemotherapeutic agents that can be combined with or used in conjunction with the nucleic acid molecules (e.g. siNA molecules) of the instant invention. Those skilled in the art will recognize that other anti-cancer compounds and therapies can similarly be readily combined with the nucleic acid molecules of the instant invention (e.g. siNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J. B. Lippincott Company, Philadelphia, USA; incorporated herein by reference) and include, without limitation, folates, antifolates, pyrimidine analogs, fluoropyrimidines, purine analogs, adenosine analogs, topoisomerase I inhibitors, anthrapyrazoles, retinoids, antibiotics, anthacyclins, platinum analogs, alkylating agents, nitrosoureas, plant derived compounds such as vinca alkaloids, epipodophyllotoxins, tyrosine kinase inhibitors, taxols, radiation therapy, surgery, nutritional supplements, gene therapy, radiotherapy, for example 3D-CRT, immunotoxin therapy, for example ricin, and monoclonal antibodies. Specific examples of chemotherapeutic compounds that can be combined with or used in conjuction with the nucleic acid molecules of the invention include, but are not limited to, Paclitaxel; Docetaxel; Methotrexate; Doxorubin; Edatrexate; Vinorelbine; Tomaxifen; Leucovorin; 5-fluoro uridine (5-FU); Ionotecan; Cisplatin; Carboplatin; Amsacrine; Cytarabine; Bleomycin; Mitomycin C; Dactinomycin; Mithramycin; Hexamethylmelamine; Dacarbazine; L-asperginase; Nitrogen mustard; Melphalan, Chlorambucil; Busulfan; Ifosfamide; 4-hydroperoxycyclophosphamide; Thiotepa; Irinotecan (CAMPTOSAR®, CPT-11, Camptothecin-11, Campto) Tamoxifen; Herceptin; IMC C225; ABX-EGF; and combinations thereof. Non-limiting examples of therapies and compounds that can be used in combination with siNA molecules of the invention for ocular based diseases and conditions include submacular surgery, focal laser retinal photocoagulation, limited macular translocation surgery, retina and retinal pigment epithelial transplantation, retinal microchip prosthesis, feeder vessel CNVM laser photocoagulation, interferon alpha treatment, intravitreal steroid therapy, transpupillary thermotherapy, membrane differential filtration therapy, aptamers targeting VEGF (e.g., Macugen™) and/or VEGF receptors, antibodies targeting VEGF (e.g., Lucentis™) and/or VEGF receptors, Visudyne™ (e.g. use in photodynamic therapy, PDT), anti-imflammatory compounds such as Celebrex™ or anecortave acetate (e.g., Retaane™), angiostatic steroids such as glucocorticoids, intravitreal implants such as Posurdex™, FGF2 modulators, antiangiogenic compounds such as squalamine, and/or VEGF traps and other cytokine traps (see for example Economides et al., 2003, Nature Medicine, 9, 47-52).

The use of anticholinergic agents, anti-inflammatories, bronchodilators, adenosine inhibitors, adenosine A1 receptor inhibitors, non-selective M3 receptor antagonists such as atropine, ipratropium brominde and selective M3 receptor antagonists such as darifenacin and revatropate are all non-limiting examples of agents that can be combined with or used in conjunction with the nucleic acid molecules (e.g. siNA molecules) of the instant invention in treating inflammatory, allergic, or respiratory diseases and conditions.

The above list of compounds are non-limiting examples of compounds and/or methods that can be combined with or used in conjunction with the nucleic acid molecules (e.g. siNA) of the instant invention. Those skilled in the art will recognize that other drug compounds and therapies can similarly be readily combined with the nucleic acid molecules of the instant invention (e.g., siNA molecules) are hence within the scope of the instant invention.

Example 12

Multifunctional siNA Inhibition of Target RNA Expression

Multifunctional siNA Design

Once target sites have been identified for multifunctional siNA constructs, each strand of the siNA is designed with a complementary region of length, for example, of about 18 to about 28 nucleotides, that is complementary to a different target nucleic acid sequence. Each complementary region is designed with an adjacent flanking region of about 4 to about 22 nucleotides that is not complementary to the target sequence, but which comprises complementarity to the complementary region of the other sequence (see for example FIG. 16). Hairpin constructs can likewise be designed (see for example FIG. 17). Identification of complementary, palindrome or repeat sequences that are shared between the different target nucleic acid sequences can be used to shorten the overall length of the multifunctional siNA constructs (see for example FIGS. 18 and 19).

In a non-limiting example, three additional categories of additional multifunctional siNA designs are presented that allow a single siNA molecule to silence multiple targets. The first method utilizes linkers to join siNAs (or multiunctional siNAs) in a direct manner. This can allow the most potent siNAs to be joined without creating a long, continuous stretch of RNA that has potential to trigger an interferon response. The second method is a dendrimeric extension of the overlapping or the linked multifunctional design; or alternatively the organization of siNA in a supramolecular format. The third method uses helix lengths greater than 30 base pairs. Processing of these siNAs by Dicer will reveal new, active 5' antisense ends. Therefore, the long siNAs can target the sites defined by the original 5' ends and those defined by the new ends that are created by Dicer processing. When used in combination with traditional multifunctional siNAs (where the sense and antisense strands each define a target) the approach can be used for example to target 4 or more sites.

I. Tethered Bifunctional siNAs

The basic idea is a novel approach to the design of multifunctional siNAs in which two antisense siNA strands are annealed to a single sense strand. The sense strand oligonucleotide contains a linker (e.g., non-nulcoetide linker as described herein) and two segments that anneal to the antisense siNA strands (see FIG. 22). The linkers can also optionally comprise nucleotide-based linkers. Several potential advantages and variations to this approach include, but are not limited to:

1. The two antisense siNAs are independent. Therefore, the choice of target sites is not constrained by a requirement for sequence conservation between two sites. Any two highly active siNAs can be combined to form a multifunctional siNA.
2. When used in combination with target sites having homology, siNAs that target a sequence present in two genes (e.g., different isoforms), the design can be used to target more than two sites. A single multifunctional siNA can be for example, used to target RNA of two different target RNAs.
3. Multifunctional siNAs that use both the sense and antisense strands to target a gene can also be incorporated into a tethered multifuctional design. This leaves open the possibility of targeting 6 or more sites with a single complex.
4. It can be possible to anneal more than two antisense strand siNAs to a single tethered sense strand.
5. The design avoids long continuous stretches of dsRNA. Therefore, it is less likely to initiate an interferon response.
6. The linker (or modifications attached to it, such as conjugates described herein) can improve the pharmacokinetic properties of the complex or improve its incorporation into liposomes. Modifications introduced to the linker should not impact siNA activity to the same extent that they would if directly attached to the siNA (see for example FIGS. 27 and 28).
7. The sense strand can extend beyond the annealed antisense strands to provide additional sites for the attachment of conjugates.
8. The polarity of the complex can be switched such that both of the antisense 3' ends are adjacent to the linker and the 5' ends are distal to the linker or combination thereof.

Dendrimer and Supramolecular siNAs

In the dendrimer siNA approach, the synthesis of siNA is initiated by first synthesizing the dendrimer template followed by attaching various functional siNAs. Various constructs are depicted in FIG. 23. The number of functional siNAs that can be attached is only limited by the dimensions of the dendrimer used.

Supramolecular Approach to Multifunctional siNA

The supramolecular format simplifies the challenges of dendrimer synthesis. In this format, the siNA strands are synthesized by standard RNA chemistry, followed by annealing of various complementary strands. The individual strand synthesis contains an antisense sense sequence of one siNA at the 5'-end followed by a nucleic acid or synthetic linker, such as hexaethyleneglyol, which in turn is followed by sense strand of another siNA in 5' to 3' direction. Thus, the synthesis of siNA strands can be carried out in a standard 3' to 5' direction. Representative examples of trifunctional and tetrafunctional siNAs are depicted in FIG. 24. Based on a similar principle, higher functionality siNA constucts can be designed as long as efficient annealing of various strands is achieved.

Dicer Enabled Multifunctional siNA

Using bioinformatic analysis of multiple targets, stretches of identical sequences shared between differeing target sequences can be identified ranging from about two to about fourteen nucleotides in length. These identical regions can be designed into extended siNA helixes (e.g., >30 base pairs) such that the processing by Dicer reveals a secondary functional 5'-antisense site (see for example FIG. 25). For example, when the first 17 nucleotides of a siNA antisense strand (e.g., 21 nucleotide strands in a duplex with 3'-TT overhangs) are complementary to a target RNA, robust silencing was observed at 25 nM. 80% silencing was observed with only 16 nucleotide complementarity in the same format.

Incorporation of this property into the designs of siNAs of about 30 to 40 or more base pairs results in additional multifunctional siNA constructs. The example in FIG. 25 illustrates how a 30 base-pair duplex can target three distinct sequences after processing by Dicer-RNaseIII; these sequences can be on the same mRNA or separate RNAs, such as viral and host factor messages, or multiple points along a given pathway (e.g., inflammatory cascades). Furthermore, a 40 base-pair duplex can combine a bifunctional design in tandem, to provide a single duplex targeting four target sequences. An even more extensive approach can include use of homologous sequences to enable five or six targets silenced for one multifunctional duplex. The example in FIG. 25 demonstrates how this can be achieved. A 30 base pair duplex is cleaved by Dicer into 22 and 8 base pair products from either end (8 b.p. fragments not shown). For ease of presentation the overhangs generated by dicer are not shown—but can be compensated for. Three targeting sequences are shown. The required sequence identity overlapped is indicated by grey boxes. The N's of the parent 30 b.p. siNA are suggested sites of 2'-OH positions to enable Dicer cleavage if this is tested in stabilized chemistries. Note that processing of a 30 mer duplex by Dicer RNase III does not give a precise 22+8 cleavage, but rather produces a series of closely related products (with 22+8 being the primary site). Therefore, processing by Dicer will yield a series of active siNAs. Another non-limiting example is shown in FIG. 26. A 40 base pair duplex is cleaved by Dicer into 20 base pair products from either end. For ease of presentation the overhangs generated by dicer are not shown—but can be compensated for. Four targeting sequences are shown in four colors, blue, light-blue and red and orange. The required sequence identity overlapped is indicated by grey boxes. This design format can be extended to larger RNAs. If chemically stabilized siNAs are bound by Dicer, then strategically located ribonucleotide linkages can enable designer cleavage products that permit our more extensive repertoire of multiifunctional designs. For example cleavage products not limited to the Dicer standard of approximately 22-nucleotides can allow multifunctional siNA constructs with a target sequence identity overlap ranging from, for example, about 3 to about 15 nucleotides.

Example 13

Diagnostic Uses

The siNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of siNA molecules involves utilizing reconstituted RNAi systems, for example, using cellular lysates or partially purified cellular lysates. siNA molecules of this invention can be used as diagnostic tools to examine genetic drift and mutations within diseased cells or to detect the presence of endogenous or exogenous, for example viral, RNA in a cell. The close relationship between siNA activity and the structure of the target RNA allows the detection of mutations in any region of the molecule, which alters the base-pairing and three-dimensional structure of the target RNA. By using multiple siNA molecules described in this invention, one can map nucleotide changes, which are important to RNA structure and function in vitro, as well as in cells and tissues. Cleavage of target RNAs with siNA molecules can be used to inhibit gene expression and define the role of specified gene products in the progression of disease or infection. In this manner, other genetic targets can be defined as important mediators of the disease. These experiments will lead to better treatment of the disease progression by affording the possibility of combination therapies (e.g., multiple siNA molecules targeted to different genes, siNA molecules coupled with known small molecule inhibitors, or intermittent treatment with combinations siNA molecules and/or other chemical or biological molecules). Other in vitro uses of siNA molecules of this invention are well known in the art, and include detection of the presence of mRNAs associated with a disease, infection, or related condition. Such RNA is detected by determining the presence of a cleavage product after treatment with a siNA using standard methodologies, for example, fluorescence resonance emission transfer (FRET).

In a specific example, siNA molecules that cleave only wild-type or mutant forms of the target RNA are used for the assay. The first siNA molecules (i.e., those that cleave only wild-type forms of target RNA) are used to identify wild-type RNA present in the sample and the second siNA molecules (i.e., those that cleave only mutant forms of target RNA) are used to identify mutant RNA in the sample. As reaction controls, synthetic substrates of both wild-type and mutant RNA are cleaved by both siNA molecules to demonstrate the relative siNA efficiencies in the reactions and the absence of cleavage of the "non-targeted" RNA species. The cleavage products from the synthetic substrates also serve to generate size markers for the analysis of wild-type and mutant RNAs in the sample population. Thus, each analysis requires two siNA molecules, two substrates and one unknown sample, which is combined into six reactions. The presence of cleavage products is determined using an RNase protection assay so that fill-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., disease related or infection related) is adequate to establish risk. If probes of comparable specific activity are used for both transcripts, then a qualitative comparison of RNA levels is adequate and decreases the cost of the initial diagnosis. Higher mutant form to wild-type ratios are correlated with higher risk whether RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying siNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

TABLE I

VEGF and/or VEGFR Accession Numbers

NM_005429
*Homo sapiens* vascular endothelial growth factor C (VEGFC), mRNA
gi|19924300|ref|NM_005429.2|[19924300]
NM_003376
*Homo sapiens* vascular endothelial growth factor (VEGF), mRNA
gi|19923239|ref|NM_003376.2|[19923239]
AF095785
*Homo sapiens* vascular endothelial growth factor (VEGF) gene, promoter region and partial cds
gi|4154290|gb|AF095785.1|[4154290]
NM_003377
*Homo sapiens* vascular endothelial growth factor B (VEGFB), mRNA
gi|20070172|ref|NM_003377.2|[20070172]
AF486837
*Homo sapiens* vascular endothelial growth factor isoform VEGF165 (VEGF) mRNA, complete cds
gi|19909064|gb|AF486837.1|[19909064]
AF468110
*Homo sapiens* vascular endothelial growth factor B isoform (VEGFB) gene, complete cds, alternatively spliced
gi|18766397|gb|AF468110.1|[18766397]
AF437895
*Homo sapiens* vascular endothelial growth factor (VEGF) gene, partial cds
gi|16660685|gb|AF437895.1|AF437895[16660685]
AY047581
*Homo sapiens* vascular endothelial growth factor (VEGF) mRNA, complete cds
gi|15422108|gb|AY047581.1|[15422108]
AF063657
*Homo sapiens* vascular endothelial growth factor receptor (FLT1) mRNA, complete cds
gi|3132830|gb|AF063657.1|AF063657[3132830]
AF092127
*Homo sapiens* vascular endothelial growth factor (VEGF) gene, partial sequence
gi|4139168|gb|AF092127.1|AF092127[4139168]
AF092126

TABLE I-continued

VEGF and/or VEGFR Accession Numbers

*Homo sapiens* vascular endothelial growth factor (VEGF) gene, 5' UTR
gi|4139167|gb|AF092126.1|AF092126[4139167]
AF092125
*Homo sapiens* vascular endothelial growth factor (VEGF) gene, partial cds
gi|4139165|gb|AF092125.1|AF092125[4139165]
E15157
Human VEGF mRNA
gi|5709840|dbj|E15157.1||pat|JP|1998052285|2[5709840]
E15156
Human VEGF mRNA
gi|5709839|dbj|E15156.1||pat|JP|1998052285|1[5709839]
E14233
Human mRNA for vascular endothelial growth factor (VEGF), complete cds
gi|5708916|dbj|E14233.1||pat|JP|1997286795|1[5708916]
AF024710
*Homo sapiens* vascular endothelial growth factor (VEGF) mRNA, 3'UTR
gi|2565322|gb|AF024710.1|AF024710[2565322]
AJ010438
*Homo sapiens* mRNA for vascular endothelial growth factor, splicing variant VEGF183
gi|3647280|emb|AJ010438.1|HSA010438[3647280]
AF098331
*Homo sapiens* vascular endothelial growth factor (VEGF) gene, promoter, partial sequence
gi|4235431|gb|AF098331.1|AF098331[4235431]
AF022375
*Homo sapiens* vascular endothelial growth factor mRNA, complete cds
gi|3719220|gb|AF022375.1|AF022375[3719220]
AH006909
vascular endothelial growth factor {alternative splicing} [human, Genomic, 414 nt 5 segments]
gi|1680143|gb|AH006909.1||bbm|191843[1680143]
U01134
Human soluble vascular endothelial cell growth factor receptor (sflt) mRNA, complete cds
gi|451321|gb|U01134.1|U01134[451321]
E14000
Human mRNA for FLT
gi|3252767|dbj|E14000.1||pat|JP|1997255700|1[3252767]
E13332
cDNA encoding vascular endodermal cell growth factor VEGF
gi|3252137|dbj|E13332.1||pat|JP|1997173075|1[3252137]
E13256
Human mRNA for FLT, complete cds
gi|3252061|dbj|E13256.1||pat|JP|1997154588|1[3252061]
AF063658
*Homo sapiens* vascular endothelial growth factor receptor 2 (KDR) mRNA, complete cds
gi|3132832|gb|AF063658.1|AF063658[3132832]
AJ000185
*Homo Sapiens* mRNA for vascular endothelial growth factor-D
gi|2879833|emb|AJ000185.1|HSAJ185[2879833]
D89630
*Homo sapiens* mRNA for VEGF-D, complete cds
gi|2780339|dbj|D89630.1|[2780339]
AF035121
*Homo sapiens* KDR/flk-1 protein mRNA, complete cds
gi|2655411|gb|AF035121.1|AF035121[2655411]
AF020393
*Homo sapiens* vascular endothelial growth factor C gene, partial cds and 5' upstream region
gi|2582366|gb|AF020393.1|AF020393[2582366]
Y08736
*H. sapiens* vegf gene, 3'UTR
gi|1619596|emb|Y08736.1|HSVEGF3UT[1619596]
X62568
*H. sapiens* vegf gene for vascular endothelial growth factor

TABLE I-continued

VEGF and/or VEGFR Accession Numbers gi|37658|emb|X62568.1|HSVEGF[37658]
X94216
*H. sapiens* mRNA for VEGF-C protein
gi|1177488|emb|X94216.1|HSVEGFC[1177488]
NM_002020
*Homo sapiens* fms-related tyrosine kinase 4 (FLT4), mRNA
gi|4503752|ref|NM_002020.1|[4503752]
NM_002253
*Homo sapiens* kinase insert domain receptor (a type III receptor tyrosine kinase) (KDR), mRNA
gi|11321596|ref|NM_002253.1|[11321596]

TABLE II

VEGF and/or VEGFR siNA AND TARGET SEQUENCES

| Pos | Target Sequence | Seq ID | UPos | Upper seq | Seq ID | LPos | Lower seq | Seq ID |
|---|---|---|---|---|---|---|---|---|
| VEGFR1/FLT1 NM_002019.1 | | | | | | | | |
| 1 | GCGGACACUCCUCUCGGCU | 1 | 1 | GCGGACACUCCUCUCGGCU | 1 | 19 | AGCCGAGAGGAGUGUCCGC | 428 |
| 19 | UCCUCCCCGGCAGCGGCGG | 2 | 19 | UCCUCCCCGGCAGCGGCGG | 2 | 37 | CCGCCGCUGCCGGGGAGGA | 429 |
| 37 | GCGGCUCGGAGCGGGCUCC | 3 | 37 | GCGGCUCGGAGCGGGCUCC | 3 | 55 | GGAGCCCGCUCCGAGCCGC | 430 |
| 55 | CGGGGCUCGGGUGCAGCGG | 4 | 55 | CGGGGCUCGGGUGCAGCGG | 4 | 73 | CCGCUGCACCCGAGCCCCG | 431 |
| 73 | GCCAGCGGGCCGGGCGGCG | 5 | 73 | GCCAGCGGGCCGGGCGGCG | 5 | 91 | CGCCGCCAGGCCCGCUGGC | 432 |
| 91 | GAGGAUUACCCGGGGAAGU | 6 | 91 | GAGGAUUACCCGGGGAAGU | 6 | 109 | ACUUCCCCGGGUAAUCCUC | 433 |
| 109 | UGGUUGUCUCCUGGCUGGA | 7 | 109 | UGGUUGUCUCCUGGCUGGA | 7 | 127 | UCCAGCCAGGAGACAACCA | 434 |
| 127 | AGCCGCGAGACGGGCGCUC | 8 | 127 | AGCCGCGAGACGGGCGCUC | 8 | 145 | GAGCGCCCGUCUCGCGGCU | 435 |
| 145 | CAGGGCGCGGGCCGGCGG | 9 | 145 | CAGGGCGCGGGCCGGCGG | 9 | 163 | CCGCCGGCCCGCGCCCUG | 436 |
| 163 | GCGGCGAACGAGAGGACGG | 10 | 163 | GCGGCGAACGAGAGGACGG | 10 | 181 | CCGUCCUCUCGUUCGCCGC | 437 |
| 181 | GACUCUGGCGGCCGGGUCG | 11 | 181 | GACUCUGGCGGCCGGGUCG | 11 | 199 | CGACCCGGCCGCCAGAGUC | 438 |
| 199 | GUUGGCCGGGGAGCGCGG | 12 | 199 | GUUGGCCGGGGAGCGCGG | 12 | 217 | CCGCGCUCCCCGGCCAAC | 439 |
| 217 | GGCACCGGGCGAGCAGGCC | 13 | 217 | GGCACCGGGCGAGCAGGCC | 13 | 235 | GGCCUGCUCGCCCGGUGCC | 440 |
| 235 | CGCGUCGCGCUCACCAUGG | 14 | 235 | CGCGUCGCGCUCACCAUGG | 14 | 253 | CCAUGGUGAGCGCGACGCG | 441 |
| 253 | GUCAGCUACUGGGACACCG | 15 | 253 | GUCAGCUACUGGGACACCG | 15 | 271 | CGGUGUCCCAGUAGCUGAC | 442 |
| 271 | GGGGUCCUGCUGUGCGCGC | 16 | 271 | GGGGUCCUGCUGUGCGCGC | 16 | 289 | GCGCGCACAGCAGGACCCC | 443 |
| 289 | CUGCUCAGCUGUCUGCUUC | 17 | 289 | CUGCUCAGCUGUCUGCUUC | 17 | 307 | GAAGCAGACAGCUGAGCAG | 444 |
| 307 | CUCACAGGAUCUAGUUCAG | 18 | 307 | CUCACAGGAUCUAGUUCAG | 18 | 325 | CUGAACUAGAUCCUGUGAG | 445 |
| 325 | GGUUCAAAAUUAAAAGAUC | 19 | 325 | GGUUCAAAAUUAAAAGAUC | 19 | 343 | GAUCUUUUAAUUUUGAACC | 446 |
| 343 | CCUGAACUGAGUUUAAAAG | 20 | 343 | CCUGAACUGAGUUUAAAAG | 20 | 361 | CUUUUAAACUCAGUUCAGG | 447 |
| 361 | GGCACCCAGCACAUCAUGC | 21 | 361 | GGCACCCAGCACAUCAUGC | 21 | 379 | GCAUGAUGUGCUGGGUGCC | 448 |
| 379 | CAAGCAGGCCAGACACUGC | 22 | 379 | CAAGCAGGCCAGACACUGC | 22 | 397 | GCAGUGUCUGGCCUGCUUG | 449 |
| 397 | CAUCUCCAAUGCAGGGGGG | 23 | 397 | CAUCUCCAAUGCAGGGGGG | 23 | 415 | CCCCCCUGCAUUGGAGAUG | 450 |
| 415 | GAAGCAGCCCAUAAAUGGU | 24 | 415 | GAAGCAGCCCAUAAAUGGU | 24 | 433 | ACCAUUUAUGGGCUGCUUC | 451 |
| 433 | UCUUUGCCUGAAAUGGUGA | 25 | 433 | UCUUUGCCUGAAAUGGUGA | 25 | 451 | UCACCAUUUCAGGCAAAGA | 452 |
| 451 | AGUAAGGAAAGCGAAAGGC | 26 | 451 | AGUAAGGAAAGCGAAAGGC | 26 | 469 | GCCUUUCGCUUUCCUUACU | 453 |
| 469 | CUGAGCAUAACUAAAUCUG | 27 | 469 | CUGAGCAUAACUAAAUCUG | 27 | 487 | CAGAUUUAGUUAUGCUCAG | 454 |
| 487 | GCCUGUGGAAGAAAUGGCA | 28 | 487 | GCCUGUGGAAGAAAUGGCA | 28 | 505 | UGCCAUUUCUUCCACAGGC | 455 |
| 505 | AAACAAUUCUGCAGUACUU | 29 | 505 | AAACAAUUCUGCAGUACUU | 29 | 523 | AAGUACUGCAGAAUUGUUU | 456 |
| 523 | UUAACCUUGAACACAGCUC | 30 | 523 | UUAACCUUGAACACAGCUC | 30 | 541 | GAGCUGUGUUCAAGGUUAA | 457 |
| 541 | CAAGCAAACCACACUGGCU | 31 | 541 | CAAGCAAACCACACUGGCU | 31 | 559 | AGCCAGUGUGGUUUGCUUG | 458 |
| 559 | UUCUACAGCUGCAAAUAUC | 32 | 559 | UUCUACAGCUGCAAAUAUC | 32 | 577 | GAUAUUUGCAGCUGUAGAA | 459 |
| 577 | CUAGCUGUACCUACUUCAA | 33 | 577 | CUAGCUGUACCUACUUCAA | 33 | 595 | UUGAAGUAGGUACAGCUAG | 460 |
| 595 | AAGAAGAAGGAAACAGAAU | 34 | 595 | AAGAAGAAGGAAACAGAAU | 34 | 613 | AUUCUGUUUCCUUCUUCUU | 461 |
| 613 | UCUGCAAUCUAUAUAUUUA | 35 | 613 | UCUGCAAUCUAUAUAUUUA | 35 | 631 | UAAAUAUAUAGAUUGCAGA | 462 |
| 631 | AUUAGUGAUACAGGUAGAC | 36 | 631 | AUUAGUGAUACAGGUAGAC | 36 | 649 | GUCUACCUGUAUCACUAAU | 463 |
| 649 | CCUUUCGUAGAGAUGUACA | 37 | 649 | CCUUUCGUAGAGAUGUACA | 37 | 667 | UGUACAUCUCUACGAAAGG | 464 |
| 667 | AGUGAAAUCCCCGAAAUUA | 38 | 667 | AGUGAAAUCCCCGAAAUUA | 38 | 685 | UAAUUUCGGGGAUUUCACU | 465 |
| 685 | AUACACAUGACUGAAGGAA | 39 | 685 | AUACACAUGACUGAAGGAA | 39 | 703 | UUCCUUCAGUCAUGUGUAU | 466 |
| 703 | AGGGAGCUCGUCAUUCCCU | 40 | 703 | AGGGAGCUCGUCAUUCCCU | 40 | 721 | AGGGAAUGACGAGCUCCCU | 467 |
| 721 | UGCCGGGUUACGUCACCUA | 41 | 721 | UGCCGGGUUACGUCACCUA | 41 | 739 | UAGGUGACGUAACCCGGCA | 468 |
| 739 | AACAUCACUGUUACUUUGA | 42 | 739 | AACAUCACUGUUACUUUGA | 42 | 757 | UUAAAGUAACAGUGAUGUU | 469 |
| 757 | AAAAAGUUUCCACUUGACA | 43 | 757 | AAAAAGUUUCCACUUGACA | 43 | 775 | UGUCAAGUGGAAACUUUUU | 470 |
| 775 | ACUUUGAUCCCUGAUGGAA | 44 | 775 | ACUUUGAUCCCUGAUGGAA | 44 | 793 | UUCCAUCAGGGAUCAAAGU | 471 |
| 793 | AAACGCAUAAUCUGGGACA | 45 | 793 | AAACGCAUAAUCUGGGACA | 45 | 811 | UGUCCCAGAUUAUGCGUUU | 472 |
| 811 | AGUAGAAAGGCUUCAUCA | 46 | 811 | AGUAGAAAGGCUUCAUCA | 46 | 829 | UGAUGAAGCCCUUUCUACU | 473 |
| 829 | AUAUCAAAUGCAACGUACA | 47 | 829 | AUAUCAAAUGCAACGUACA | 47 | 847 | UGUACGUUGCAUUUGAUAU | 474 |
| 847 | AAAGAAAUAGGGCUUCUGA | 48 | 847 | AAAGAAAUAGGGCUUCUGA | 48 | 865 | UCAGAAGCCCUAUUUCUUU | 475 |
| 865 | ACCUGUGAAGCAACAGUCA | 49 | 865 | ACCUGUGAAGCAACAGUCA | 49 | 883 | UGACUGUUGCUUCACAGGU | 476 |
| 883 | AAUGGGCAUUUGUAUAAGA | 50 | 883 | AAUGGGCAUUUGUAUAAGA | 50 | 901 | UCUUAUACAAAUGCCCAUU | 477 |
| 901 | ACAAACUAUCUCACACAUC | 51 | 901 | ACAAACUAUCUCACACAUC | 51 | 919 | GAUGUGUGAGAUAGUUUGU | 478 |
| 919 | CGACAAACCAAUACAAUCA | 52 | 919 | CGACAAACCAAUACAAUCA | 52 | 937 | UGAUUGUAUUGGUUUGUCG | 479 |
| 937 | AUAGAUGUCCAAAUAAGCA | 53 | 937 | AUAGAUGUCCAAAUAAGCA | 53 | 955 | UGCUUAUUUGGACAUCUAU | 480 |
| 955 | ACACCACGCCCAGUCAAAU | 54 | 955 | ACACCACGCCCAGUCAAAU | 54 | 973 | AUUUGACUGGGCGUGGUGU | 481 |
| 973 | UUACUUAGAGGCCAUACUC | 55 | 973 | UUACUUAGAGGCCAUACUC | 55 | 991 | GAGUAUGGCCUCUAAGUAA | 482 |
| 991 | CUUGUCCUCAAUUGUACUG | 56 | 991 | CUUGUCCUCAAUUGUACUG | 56 | 1009 | CAGUACAAUUGAGGACAAG | 483 |
| 1009 | GCUACCACUCCCUUGAACA | 57 | 1009 | GCUACCACUCCCUUGAACA | 57 | 1027 | UGUUCAAGGGAGUGGUAGC | 484 |

TABLE II-continued

VEGF and/or VEGFR siNA AND TARGET SEQUENCES

| Pos | Sequence | ID | Pos | Sequence | ID | Pos | Sequence | ID |
|---|---|---|---|---|---|---|---|---|
| 1027 | ACGAGAGUUCAAAUGACCU | 58 | 1027 | ACGAGAGUUCAAAUGACCU | 58 | 1045 | AGGUCAUUUGAACUCUCGU | 485 |
| 1045 | UGGAGUUACCCUGAUGAAA | 59 | 1045 | UGGAGUUACCCUGAUGAAA | 59 | 1063 | UUUCAUCAGGGUAACUCCA | 486 |
| 1063 | AAAAAUAAGAGAGCUUCCG | 60 | 1063 | AAAAAUAAGAGAGCUUCCG | 60 | 1081 | CGGAAGCUCUCUUAUUUUU | 487 |
| 1081 | GUAAGGCGACGAAUUGACC | 61 | 1081 | GUAAGGCGACGAAUUGACC | 61 | 1099 | GGUCAAUUCGUCGCCUUAC | 488 |
| 1099 | CAAAGCAAUUCCCAUGCCA | 62 | 1099 | CAAAGCAAUUCCCAUGCCA | 62 | 1117 | UGGCAUGGGAAUUGCUUUG | 489 |
| 1117 | AACAUAUUCUACAGUGUUC | 63 | 1117 | AACAUAUUCUACAGUGUUC | 63 | 1135 | GAACACUGUAGAAUAGUGU | 490 |
| 1135 | CUUACUAUUGACAAAAUGC | 64 | 1135 | CUUACUAUUGACAAAAUGC | 64 | 1153 | GCAUUUUGUCAAUAGUAAG | 491 |
| 1153 | CAGAACAAAGACAAAGGAC | 65 | 1153 | CAGAACAAAGACAAAGGAC | 65 | 1171 | GUCCUUUGUCUUUGUUCUG | 492 |
| 1171 | CUUUAUACUUGUCGUGUAA | 66 | 1171 | CUUUAUACUUGUCGUGUAA | 66 | 1189 | UUACACGACAAGUAUAAAG | 493 |
| 1189 | AGGAGUGGACCAUCAUUCA | 67 | 1189 | AGGAGUGGACCAUCAUUCA | 67 | 1207 | UGAAUGAUGGUCCACUCCU | 494 |
| 1207 | AAAUCUGUUAACACCUCAG | 68 | 1207 | AAAUCUGUUAACACCUCAG | 68 | 1225 | CUGAGGUGUUAACAGAUUU | 495 |
| 1225 | GUGCAUAUAUAUGAUAAAG | 69 | 1225 | GUGCAUAUAUAUGAUAAAG | 69 | 1243 | CUUUAUCAUAUAUGCAC | 496 |
| 1243 | GCAUUCAUCACUGUGAAAC | 70 | 1243 | GCAUUCAUCACUGUGAAAC | 70 | 1261 | GUUUCACAGUGAUGAAUGC | 497 |
| 1261 | CAUCGAAAACAGCAGGUGC | 71 | 1261 | CAUCGAAAACAGCAGGUGC | 71 | 1279 | GCACCUGCUGUUUUCGAUG | 498 |
| 1279 | CUUGAAACCGUAGCUGGCA | 72 | 1279 | CUUGAAACCGUAGCUGGCA | 72 | 1297 | UGCCAGCUACGGUUUCAAG | 499 |
| 1297 | AAGCGGUCUUACCGGCUCU | 73 | 1297 | AAGCGGUCUUACCGGCUCU | 73 | 1315 | AGAGCCGGUAAGACCGCUU | 500 |
| 1315 | UCUAUGAAAGUGAAGGCAU | 74 | 1315 | UCUAUGAAAGUGAAGGCAU | 74 | 1333 | AUGCCUUCACUUUCAUAGA | 501 |
| 1333 | UUUCCCUCGCCGGAAGUUG | 75 | 1333 | UUUCCCUCGCCGGAAGUUG | 75 | 1351 | CAACUUCCGGCGAGGGAAA | 502 |
| 1351 | GUAUGGUUAAAAGAUGGGU | 76 | 1351 | GUAUGGUUAAAAGAUGGGU | 76 | 1369 | ACCCAUCUUUUAACCAUAC | 503 |
| 1369 | UUACCUGCGACUGAGAAAU | 77 | 1369 | UUACCUGCGACUGAGAAAU | 77 | 1387 | AUUUCUCAGUCGCAGGUAA | 504 |
| 1387 | UCUGCUCGCUAUUUGACUC | 78 | 1387 | UCUGCUCGCUAUUUGACUC | 78 | 1405 | GAGUCAAAUAGCGAGCAGA | 505 |
| 1405 | CGUGGCUACUCGUUAAUUA | 79 | 1405 | CGUGGCUACUCGUUAAUUA | 79 | 1423 | UAAUUAACGAGUAGCCACG | 506 |
| 1423 | AUCAAGGACGUAACUGAAG | 80 | 1423 | AUCAAGGACGUAACUGAAG | 80 | 1441 | CUUCAGUUACGUCCUUGAU | 507 |
| 1441 | GAGGAUGCAGGGAAUUAUA | 81 | 1441 | GAGGAUGCAGGGAAUUAUA | 81 | 1459 | UAUAAUUCCCUGCAUCCUC | 508 |
| 1459 | ACAAUCUUGCUGAGCAUAA | 82 | 1459 | ACAAUCUUGCUGAGCAUAA | 82 | 1477 | UUAUGCUCAGCAAGAUUGU | 509 |
| 1477 | AAACAGUCAAAUGUGUUUA | 83 | 1477 | AAACAGUCAAAUGUGUUUA | 83 | 1495 | UAAACACAUUUGACUGUUU | 510 |
| 1495 | AAAAACCUCACUGCCACUC | 84 | 1495 | AAAAACCUCACUGCCACUC | 84 | 1513 | GAGUGGCAGUGAGGUUUUU | 511 |
| 1513 | CUAAUUGUCAAUGUGAAAC | 85 | 1513 | CUAAUUGUCAAUGUGAAAC | 85 | 1531 | GUUUCACAUUGACAAUUAG | 512 |
| 1531 | CCCCAGAUUUACGAAAAGG | 86 | 1531 | CCCCAGAUUUACGAAAAGG | 86 | 1549 | CCUUUUCGUAAAUCUGGGG | 513 |
| 1549 | GCCGUGUCAUCGUUUCCAG | 87 | 1549 | GCCGUGUCAUCGUUUCCAG | 87 | 1567 | CUGGAAACGAUGACACGGC | 514 |
| 1567 | GACCCGGCUCUCUACCCAC | 88 | 1567 | GACCCGGCUCUCUACCCAC | 88 | 1585 | GUGGGUAGAGAGCCGGGUC | 515 |
| 1585 | CUGGGCAGCAGACAAAUCC | 89 | 1585 | CUGGGCAGCAGACAAAUCC | 89 | 1603 | GGAUUUGUCUGCUGCCCAG | 516 |
| 1603 | CUGACUUGUACCGCAUAUG | 90 | 1603 | CUGACUUGUACCGCAUAUG | 90 | 1621 | CAUAUGCGGUACAAGUCAG | 517 |
| 1621 | GGUAUCCCUCAACCUACAA | 91 | 1621 | GGUAUCCCUCAACCUACAA | 91 | 1639 | UUGUAGGUUGAGGGAUACC | 518 |
| 1639 | AUCAAGUGGUUCUGGCACC | 92 | 1639 | AUCAAGUGGUUCUGGCACC | 92 | 1657 | GGUGCCAGAACCACUUGAU | 519 |
| 1657 | CCCUGUAACCAUAAUCAUU | 93 | 1657 | CCCUGUAACCAUAAUCAUU | 93 | 1675 | AAUGAUUAUGGUUACAGGG | 520 |
| 1675 | UCCGAAGCAAGGUGUGACU | 94 | 1675 | UCCGAAGCAAGGUGUGACU | 94 | 1693 | AGUCACACCUUGCUUCGGA | 521 |
| 1693 | UUUUGUUCCAAUAAUGAAG | 95 | 1693 | UUUUGUUCCAAUAAUGAAG | 95 | 1711 | CUUCAUUAUUGGAACAAAA | 522 |
| 1711 | GAGUCCUUUAUUCCUGGAUG | 96 | 1711 | GAGUCCUUUAUUCCUGGAUG | 96 | 1729 | CAUCCAGGAUAAAGGACUC | 523 |
| 1729 | GCUGACAGCAACAUGGGAA | 97 | 1729 | GCUGACAGCAACAUGGGAA | 97 | 1747 | UUCCCAUGUUGCUGUCAGC | 524 |
| 1747 | AACAGAAUUGAGAGCAUCA | 98 | 1747 | AACAGAAUUGAGAGCAUCA | 98 | 1765 | UGAUGCUCUCAAUUCUGUU | 525 |
| 1765 | ACUCAGCGCAUGGCAAUAA | 99 | 1765 | ACUCAGCGCAUGGCAAUAA | 99 | 1783 | UUAUUGCCAUGCGCUGAGU | 526 |
| 1783 | AUAGAAAGGAAAGAAUAAGA | 100 | 1783 | AUAGAAAGGAAAGAAUAAGA | 100 | 1801 | UCUUAUUCUUUCCUUUCUAU | 527 |
| 1801 | AUGGCUAGCACCUUGGUUG | 101 | 1801 | AUGGCUAGCACCUUGGUUG | 101 | 1819 | CAACCAAGGUGCUAGCCAU | 528 |
| 1819 | GUGGCUGACUCUAGAAUUU | 102 | 1819 | GUGGCUGACUCUAGAAUUU | 102 | 1837 | AAAUUCUAGAGUCAGCCAC | 529 |
| 1837 | UCUGGAAUCUACAUUUGCA | 103 | 1837 | UCUGGAAUCUACAUUUGCA | 103 | 1855 | UGCAAAUGUAGAUUCCAGA | 530 |
| 1855 | AUAGCUUCCAAUAAAAGUUG | 104 | 1855 | AUAGCUUCCAAUAAAAGUUG | 104 | 1873 | CAACUUUUAUUGGAAGCUAU | 531 |
| 1873 | GGGACUGUGGGAAGAAACA | 105 | 1873 | GGGACUGUGGGAAGAAACA | 105 | 1891 | UGUUUCUUCCCACAGUCCC | 532 |
| 1891 | AUAAGCUUUUAUAUCACAG | 106 | 1891 | AUAAGCUUUUAUAUCACAG | 106 | 1909 | CUGUGAUAUAAAAGCUUAU | 533 |
| 1909 | GAUGUGCCAAAUGGGUUUC | 107 | 1909 | GAUGUGCCAAAUGGGUUUC | 107 | 1927 | GAAACCCAUUUGGCACAUC | 534 |
| 1927 | CAUGUUAACUUGGAAAAAA | 108 | 1927 | CAUGUUAACUUGGAAAAAA | 108 | 1945 | UUUUUUCCAAGUUAACAUG | 535 |
| 1945 | AUGCCGACGGAAGGAGAGG | 109 | 1945 | AUGCCGACGGAAGGAGAGG | 109 | 1963 | CCUCUCCUUCCGUCGGCAU | 536 |
| 1963 | GACCUGAAACUGUCUUGCA | 110 | 1963 | GACCUGAAACUGUCUUGCA | 110 | 1981 | UGCAAGACAGUUUCAGGUC | 537 |
| 1981 | ACAGUUAACAAGUUCUAU | 111 | 1981 | ACAGUUAACAAGUUCUAU | 111 | 1999 | AUAAGAACUUGUUAACUGU | 538 |
| 1999 | UACAGAGACGUUACUUGGA | 112 | 1999 | UACAGAGACGUUACUUGGA | 112 | 2017 | UCCAAGUAACGUCUCUGUA | 539 |
| 2017 | AUUUUACUGCGGACAGUUA | 113 | 2017 | AUUUUACUGCGGACAGUUA | 113 | 2035 | UAACUGUCCGCAGUAAAAU | 540 |
| 2035 | AAUAACAGAACAAUGCACU | 114 | 2035 | AAUAACAGAACAAUGCACU | 114 | 2053 | AGUGCAUUGUUCUGUUAUU | 541 |
| 2053 | UACAGUAUUAGCAAGCAAA | 115 | 2053 | UACAGUAUUAGCAAGCAAA | 115 | 2071 | UUUGCUUGCUAAUACUGUA | 542 |
| 2071 | AAAAUGGCCAUCACUAAGG | 116 | 2071 | AAAAUGGCCAUCACUAAGG | 116 | 2089 | CCUUAGUGAUGGCCAUUUU | 543 |
| 2089 | GAGCACUCCAUCACUCUUA | 117 | 2089 | GAGCACUCCAUCACUCUUA | 117 | 2107 | UAAGAGUGAUGGAGUGCUC | 544 |
| 2107 | AAUCUUACCAUCAUGAAUG | 118 | 2107 | AAUCUUACCAUCAUGAAUG | 118 | 2125 | CAUUCAUGAUGGUAAGAUU | 545 |
| 2125 | GUUUCCCUGCAAGAUUCAG | 119 | 2125 | GUUUCCCUGCAAGAUUCAG | 119 | 2143 | CUGAAUCUUGCAGGGAAAC | 546 |
| 2143 | GGCACCUAUGCCUGCAGAG | 120 | 2143 | GGCACCUAUGCCUGCAGAG | 120 | 2161 | CUCUGCAGGCAUAGGUGCC | 547 |
| 2161 | GCCAGGAAUGUAUACACAG | 121 | 2161 | GCCAGGAAUGUAUACACAG | 121 | 2179 | CUGUGUAUACAUUCCUGGC | 548 |
| 2179 | GGGGAAGAAAUCCUCCAGA | 122 | 2179 | GGGGAAGAAAUCCUCCAGA | 122 | 2197 | UCUGGAGGAUUUCUUCCCC | 549 |
| 2197 | AAGAAAGAAAUUACAAUCA | 123 | 2197 | AAGAAAGAAAUUACAAUCA | 123 | 2215 | UGAUUGUAAUUUCUUUCUU | 550 |
| 2215 | AGAGAUCAGGAAGCACCAU | 124 | 2215 | AGAGAUCAGGAAGCACCAU | 124 | 2233 | AUGGUGCUUCCUGAUCUCU | 551 |
| 2233 | UACCUCCUGCGAAACCUCA | 125 | 2233 | UACCUCCUGCGAAACCUCA | 125 | 2251 | UGAGGUUUCGCAGGAGGUA | 552 |
| 2251 | AGUGAUCACACAGUGGCCA | 126 | 2251 | AGUGAUCACACAGUGGCCA | 126 | 2269 | UGGCCACUGUGUGAUCACU | 553 |
| 2269 | AUCAGCAGUUCCACCACUU | 127 | 2269 | AUCAGCAGUUCCACCACUU | 127 | 2287 | AAGUGGUGGAACUGCUGAU | 554 |
| 2287 | UUAGACUGUCAUGCUAAUG | 128 | 2287 | UUAGACUGUCAUGCUAAUG | 128 | 2305 | CAUUAGCAUGACAGUCUAA | 555 |
| 2305 | GGGUCCCCGAGCCUCACA | 129 | 2305 | GGGUCCCCGAGCCUCACA | 129 | 2323 | UCUGAGGCUCGGGGACCCC | 556 |
| 2323 | AUCACUUGGUUUAAAAACA | 130 | 2323 | AUCACUUGGUUUAAAAACA | 130 | 2341 | UGUUUUUAAACCAAGUGAU | 557 |
| 2341 | AACCACAAAAAUACAACAG | 131 | 2341 | AACCACAAAAAUACAACAG | 131 | 2359 | CUUGUUGUAUUUUGUGGUU | 558 |
| 2359 | GAGCCUGGAAUUAUUUAG | 132 | 2359 | GAGCCUGGAAUUAUUUAG | 132 | 2377 | CUAAAUAAUUCCAGGCUC | 559 |
| 2377 | GGACCAGGAAGCAGCACGC | 133 | 2377 | GGACCAGGAAGCAGCACGC | 133 | 2395 | GCGUGCUGCUUCCUGGUCC | 560 |
| 2395 | CUGUUUAUUGAAAGAGUCA | 134 | 2395 | CUGUUUAUUGAAAGAGUCA | 134 | 2413 | UGACUCUUUCAAUAAACAG | 561 |

TABLE II-continued

VEGF and/or VEGFR siNA AND TARGET SEQUENCES

| | | | | | | | | |
|---|---|---|---|---|---|---|---|---|
| 2413 | ACAGAAGAGGAUGAAGGUG | 135 | 2413 | ACAGAAGAGGAUGAAGGUG | 135 | 2431 | CACCUUCAUCCUCUUCUGU | 562 |
| 2431 | GUCUAUCACUGCAAAGCCA | 136 | 2431 | GUCUAUCACUGCAAAGCCA | 136 | 2449 | UGGCUUUGCAGUGAUAGAC | 563 |
| 2449 | ACCAACCAGAAGGGCUCUG | 137 | 2449 | ACCAACCAGAAGGGCUCUG | 137 | 2467 | CAGAGCCCUUCUGGUUGGU | 564 |
| 2467 | GUGGAAAGUUCAGCAUACC | 138 | 2467 | GUGGAAAGUUCAGCAUACC | 138 | 2485 | GGUAUGCUGAACUUUCCAC | 565 |
| 2485 | CUCACUGUUCAAGGAACCU | 139 | 2485 | CUCACUGUUCAAGGAACCU | 139 | 2503 | AGGUUCCUUGAACAGUGAG | 566 |
| 2503 | UCGGACAAGUCUAAUCUGG | 140 | 2503 | UCGGACAAGUCUAAUCUGG | 140 | 2521 | CCAGAUUAGACUUGUCCGA | 567 |
| 2521 | GAGCUGAUCACUCUAACAU | 141 | 2521 | GAGCUGAUCACUCUAACAU | 141 | 2539 | AUGUUAGAGUGAUCAGCUC | 568 |
| 2539 | UGCACCUGUGUGGCUGCGA | 142 | 2539 | UGCACCUGUGUGGCUGCGA | 142 | 2557 | UCGCAGCCACACAGGUGCA | 569 |
| 2557 | ACUCUCUUCUGGCUCCUAU | 143 | 2557 | ACUCUCUUCUGGCUCCUAU | 143 | 2575 | AUAGGAGCCAGAAGAGAGU | 570 |
| 2575 | UUAACCCUCCUUAUCCGAA | 144 | 2575 | UUAACCCUCCUUAUCCGAA | 144 | 2593 | UUCGGAUAAGGAGGGUUAA | 571 |
| 2593 | AAAAUGAAAAGGUCUUCUU | 145 | 2593 | AAAAUGAAAAGGUCUUCUU | 145 | 2611 | AAGAAGACCUUUUCAUUUU | 572 |
| 2611 | UCUGAAAUAAAGACUGACU | 146 | 2611 | UCUGAAAUAAAGACUGACU | 146 | 2629 | AGUCAGUCUUUAUUUCAGA | 573 |
| 2629 | UACCUAUCAAUUAUAAUGG | 147 | 2629 | UACCUAUCAAUUAUAAUGG | 147 | 2647 | CCAUUAUAAUUGAUAGGUA | 574 |
| 2647 | GACCCAGAUGAAGUUCCUU | 148 | 2647 | GACCCAGAUGAAGUUCCUU | 148 | 2665 | AAGGAACUUCAUCUGGGUC | 575 |
| 2665 | UUGGAUGAGCAGUGUGAGC | 149 | 2665 | UUGGAUGAGCAGUGUGAGC | 149 | 2683 | GCUCACACUGCUCAUCCAA | 576 |
| 2683 | CGGCUCCCUUAUGAUGCCA | 150 | 2683 | CGGCUCCCUUAUGAUGCCA | 150 | 2701 | UGGCAUCAUAAGGGAGCCG | 577 |
| 2701 | AGCAAGUGGGAGUUUGCCC | 151 | 2701 | AGCAAGUGGGAGUUUGCCC | 151 | 2719 | GGGCAAACUCCCACUUGCU | 578 |
| 2719 | CGGGAGAGACUUAAACUGG | 152 | 2719 | CGGGAGAGACUUAAACUGG | 152 | 2737 | CCAGUUUAAGUCUCUCCCG | 579 |
| 2737 | GGCAAAUCACUUGGAAGAG | 153 | 2737 | GGCAAAUCACUUGGAAGAG | 153 | 2755 | CUCUUCCAAGUGAUUUGCC | 580 |
| 2755 | GGGGCUUUUGGAAAAGUGG | 154 | 2755 | GGGGCUUUUGGAAAAGUGG | 154 | 2773 | CCACUUUUCCAAAAGCCCC | 581 |
| 2773 | GUUCAAGCAUCAGCAUUUG | 155 | 2773 | GUUCAAGCAUCAGCAUUUG | 155 | 2791 | CAAAUGCUGAUGCUUGAAC | 582 |
| 2791 | GGCAUUAAGAAAAUCACCUA | 156 | 2791 | GGCAUUAAGAAAAUCACCUA | 156 | 2809 | UAGGUGAUUUCUUAAUGCC | 583 |
| 2809 | ACGUGCCGGACUGUGGCUG | 157 | 2809 | ACGUGCCGGACUGUGGCUG | 157 | 2827 | CAGCCACAGUCCGGCACGU | 584 |
| 2827 | GUGAAAAUGCUGAAAGAGG | 158 | 2827 | GUGAAAAUGCUGAAAGAGG | 158 | 2845 | CCUCUUUCAGCAUUUUCAC | 585 |
| 2845 | GGGGCCACGGCCAGCGAGU | 159 | 2845 | GGGGCCACGGCCAGCGAGU | 159 | 2863 | ACUCGCUGGCCGUGGCCCC | 586 |
| 2863 | UACAAAGCUCUGAUGACUG | 160 | 2863 | UACAAAGCUCUGAUGACUG | 160 | 2881 | CAGUCAUCAGAGCUUUGUA | 587 |
| 2881 | GAGCUAAAAAUCUUGACCC | 161 | 2881 | GAGCUAAAAAUCUUGACCC | 161 | 2899 | GGGUCAAGAUUUUUAGCUC | 568 |
| 2899 | CACAUUGGCCACCAUCUGA | 162 | 2899 | CACAUUGGCCACCAUCUGA | 162 | 2917 | UCAGAUGGUGGCCAAUGUG | 589 |
| 2917 | AACGUGGUUAACCUGCUGG | 163 | 2917 | AACGUGGUUAACCUGCUGG | 163 | 2935 | CCAGCAGGUUAACCACGUU | 590 |
| 2935 | GGAGCCUGCAGCAAGCAAG | 164 | 2935 | GGAGCCUGCACCAAGCAAG | 164 | 2953 | CUUGCUUGGUGCAGGCUCC | 591 |
| 2953 | GGAGGGCCUCUGAUGGUGA | 165 | 2953 | GGAGGGCCUCUGAUGGUGA | 165 | 2971 | UCACCACCAGAGGCCCUCC | 592 |
| 2971 | AUUGUUGAAUACUGCAAAU | 166 | 2971 | AUUGUUGAAUACUGCAAAU | 166 | 2989 | AUUUGCAGUAUUCAACAAU | 593 |
| 2989 | UAUGGAAAUCUCUCCAACU | 167 | 2989 | UAUGGAAAUCUCUCCAACU | 167 | 3007 | AGUUGGAGAGAUUUCCAUA | 594 |
| 3007 | UACCUCAAGAGCAAACGUG | 168 | 3007 | UACCUCAAGAGCAAACGUG | 168 | 3025 | CACGUUUGCUCUUGAGGUA | 595 |
| 3025 | GACUUAUUUUUUCUCACACA | 169 | 3025 | GACUUAUUUUUUCUCACACA | 169 | 3043 | UGUUGAGAAAAAAUAAGUC | 596 |
| 3043 | AAGGAUGCAGCACUACACA | 170 | 3043 | AAGGAUGCAGCACUACACA | 170 | 3061 | UGUGUAGUGCUGCAUCCUU | 597 |
| 3061 | AUGGAGCCUAAGAAAGAAA | 171 | 3061 | AUGGAGCCUAAGAAAGAAA | 171 | 3079 | UUUCUUUCUUAGGCUCCAU | 598 |
| 3079 | AAAAUGGAGCCAGGCCUGG | 172 | 3079 | AAAAUGGAGCCAGGCCUGG | 172 | 3097 | CCAGGCCUGGCUCCAUUUU | 599 |
| 3097 | GAACAAGCAAGAAACCAA | 173 | 3097 | GAACAAGCAAGAAACCAA | 173 | 3115 | UUGGUUUCUUGCCUUGUUC | 600 |
| 3115 | AGACUAGAUAGCGUCACCA | 174 | 3115 | AGACUAGAUAGCGUCACCA | 174 | 3133 | UGGUGACGCUAUCUAGUCU | 601 |
| 3133 | AGCAGCGAAAGCUUUGCGA | 175 | 3133 | AGCAGCGAAAGCUUUGCGA | 175 | 3151 | UCGCAAAGCUUUCGCUGCU | 602 |
| 3151 | AGCUCCGGCUUUCAGGAAG | 176 | 3151 | AGCUCCGGCUUUCAGGAAG | 176 | 3169 | CUUCCUGAAAGCCGGAGCU | 603 |
| 3169 | GAUAAAAGUCUGAGUGAUG | 177 | 3169 | GAUAAAAGUCUGAGUGAUG | 177 | 3187 | CAUCACUCAGACUUUUAUC | 604 |
| 3187 | GUUGAGGAAGAGGAGGAUU | 178 | 3187 | GUUGAGGAAGAGGAGGAUU | 178 | 3205 | AAUCCUCCUCUUCCUCAAC | 605 |
| 3205 | UCUGACGGUUUCUACAAGG | 179 | 3205 | UCUGACGGUUUCUACAAGG | 179 | 3223 | CCUUGUAGAAACCGUCAGA | 606 |
| 3223 | GAGCCCAUCACUAUGGAAG | 180 | 3223 | GAGCCCAUCACUAUGGAAG | 180 | 3241 | CUUCCAUAGUGAUGGGCUC | 607 |
| 3241 | GAUCUGAUUUCUUACAGUU | 181 | 3241 | GAUCUGAUUUCUUACAGUU | 181 | 3259 | AACUGUAAGAAAUCAGAUC | 608 |
| 3259 | UUUCAAGUGGCCAGAGGCA | 182 | 3259 | UUUCAAGUGGCCAGAGGCA | 182 | 3277 | UGCCUCUGGCCACUUGAAA | 609 |
| 3277 | AUGGAGUUCCUGUCUUCCA | 183 | 3277 | AUGGAGUUCCUGUCUUCCA | 183 | 3295 | UGGAAGACAGGAACUCCAU | 610 |
| 3295 | AGAAAGUGCAUUCAUCGGG | 184 | 3295 | AGAAAGUGCAUUCAUCGGG | 184 | 3313 | CCCGAUGAAUGCACUUUCU | 611 |
| 3313 | GACCUGGCAGCGAGAAACA | 185 | 3313 | GACCUGGCAGCGAGAAACA | 185 | 3331 | UGUUUCUCGCUGCCAGGUC | 612 |
| 3331 | AUUCUUUUAUCUGAGAACA | 186 | 3331 | AUUCUUUUAUCUGAGAACA | 186 | 3349 | UGUUCUCAGAUAAAAGAAU | 613 |
| 3349 | AACGUGGUGAAGAUUUGUG | 187 | 3349 | AACGUGGUGAAGAUUUGUG | 187 | 3367 | CACAAAUCUUCACCACGUU | 614 |
| 3367 | GAUUUUGGCCUUGCCCGGG | 188 | 3367 | GAUUUUGGCCUUGCCCGGG | 188 | 3385 | CCCGGGCAAGGCCAAAAUC | 615 |
| 3385 | GAUAUUUAUAAGAACCCCG | 189 | 3385 | GAUAUUUAUAAGAACCCCG | 189 | 3403 | CGGGGUUCUUAUAAAUAUC | 616 |
| 3403 | GAUUAUGUGAGAAAAGGAG | 190 | 3403 | GAUUAUGUGAGAAAAGGAG | 190 | 3421 | CUCCUUUUCUCACAUAAUC | 617 |
| 3421 | GAUACUCGACUUCCUCUGA | 191 | 3421 | GAUACUCGACUUCCUCUGA | 191 | 3439 | UCAGAGGAAGUCGAGUAUC | 618 |
| 3439 | AAAUGGAUGGCUCCCGAAU | 192 | 3439 | AAAUGGAUGGCUCCCGAAU | 192 | 3457 | AUUCGGGAGCCAUCCAUUU | 619 |
| 3457 | UCUAUCUUUGACAAAAUCU | 193 | 3457 | UCUAUCUUUGACAAAAUCU | 193 | 3475 | AGAUUUUGUCAAAGAUAGA | 620 |
| 3475 | UACAGCACCAAGAGCGACG | 194 | 3475 | UACAGCACCAAGAGCGACG | 194 | 3493 | CGUCGCUCUUGGUGCUGUA | 621 |
| 3493 | GUGUGGUCUUACGGAGUAU | 195 | 3493 | GUGUGGUCUUACGGAGUAU | 195 | 3511 | AUACUCCGUAAGACCACAC | 622 |
| 3511 | UUGCUGUGGGAAAUCUUCU | 196 | 3511 | UUGCUGUGGGAAAUCUUCU | 196 | 3529 | AGAAGAUUUCCCACAGCAA | 623 |
| 3529 | UCCUUAGGUGGGUCUCCAU | 197 | 3529 | UCCUUAGGUGGGUCUCCAU | 197 | 3547 | AUGGAGACCCACCUAAGGA | 624 |
| 3547 | UACCCAGGAGUACAAAUGG | 198 | 3547 | UACCCAGGAGUACAAAUGG | 198 | 3565 | CCAUUUGUACUCCUGGGUA | 625 |
| 3565 | GAUGAGGACUUUUGCAGUC | 199 | 3565 | GAUGAGGACUUUUGCAGUC | 199 | 3583 | GACUGCAAAAGUCCUCAUC | 626 |
| 3583 | CGCCUGAGGGAAGGCAUGA | 200 | 3583 | CGCCUGAGGGAAGGCAUGA | 200 | 3601 | UCAUGCCUUCCCUCAGGCG | 627 |
| 3601 | AGGAUGAGAGCUCCUGAGU | 201 | 3601 | AGGAUGAGAGCUCCUGAGU | 201 | 3619 | ACUCAGGAGCUCUCAUCCU | 628 |
| 3619 | UACUCUACUCCUGAAAUCU | 202 | 3619 | UACUCUACUCCUGAAAUCU | 202 | 3637 | AGAUUUCAGGAGUAGAGUA | 629 |
| 3637 | UAUCAGAUCAUGCUGGACU | 203 | 3637 | UAUCAGAUCAUGCUGGACU | 203 | 3655 | AGUCCAGCAUGAUCUGAUA | 630 |
| 3655 | UGCUGGCACAGAGACCCAA | 204 | 3655 | UGCUGGCACAGAGACCCAA | 204 | 3673 | UUGGGUCUCUGUGCCAGCA | 631 |
| 3673 | AAAGAAAGGCCAAGAUUUG | 205 | 3673 | AAAGAAAGGCCAAGAUUUG | 205 | 3691 | CAAAUCUUGGCCUUUCUUU | 632 |
| 3691 | GCAGAACUUGUGGAAAAC | 206 | 3691 | GCAGAACUUGUGGAAAAC | 206 | 3709 | GUUUUCCACAAGUUCUGC | 633 |
| 3709 | CUAGGUGAUUUGCUUCAAG | 207 | 3709 | CUAGGUGAUUUGCUUCAAG | 207 | 3727 | CUUGAAGCAAAUCACCUAG | 634 |
| 3727 | GCAAAUGUACAACAGGAUG | 208 | 3727 | GCAAAUGUACAACAGGAUG | 208 | 3745 | CAUCCUGUUGUACAUUUGC | 635 |
| 3745 | GGUAAAGACUACAUCCCAA | 209 | 3745 | GGUAAAGACUACAUCCCAA | 209 | 3763 | UUGGGAUGUAGUCUUUACC | 636 |
| 3763 | AUCAAUGCCAUACUGACAG | 210 | 3763 | AUCAAUGCCAUACUGACAG | 210 | 3781 | CUGUCAGUAUGGCAUUGAU | 637 |
| 3781 | GGAAAUAGUGGGUUUACAU | 211 | 3781 | GGAAAUAGUGGGUUUACAU | 211 | 3799 | AUGUAAACCCACUAUUUCC | 638 |

TABLE II-continued

VEGF and/or VEGFR siNA AND TARGET SEQUENCES

| | | | | | |
|---|---|---|---|---|---|
| 3799 UACUCAACUCCUGCCUUCU | 212 | 3799 UACUCAACUCCUGCCUUCU | 212 | 3817 AGAAGGCAGGAGUUGAGUA | 639 |
| 3817 UCUGAGGACUUCUUCAAGG | 213 | 3817 UCUGAGGACUUCUUCAAGG | 213 | 3835 CCUUGAAGAAGUCCUCAGA | 640 |
| 3835 GAAAGUAUUUCAGCUCCGA | 214 | 3835 GAAAGUAUUUCAGCUCCGA | 214 | 3853 UCGGAGCUGAAAUACUUUC | 641 |
| 3853 AAGUUUAAUUCAGGAAGCU | 215 | 3853 AAGUUUAAUUCAGGAAGCU | 215 | 3871 AGCUUCCUGAAUUAAACUU | 642 |
| 3871 UCUGAUGAUGUCAGAUAUG | 216 | 3871 UCUGAUGAUGUCAGAUAUG | 216 | 3889 CAUAUCUGACAUCAUCAGA | 643 |
| 3889 GUAAAUGCUUUCAAGUUCA | 217 | 3889 GUAAAUGCUUUCAAGUUCA | 217 | 3907 UGAACUUGAAAGCAUUUAC | 644 |
| 3907 AUGAGCCUGGAAAGAAUCA | 218 | 3907 AUGAGCCUGGAAAGAAUCA | 218 | 3925 UGAUUCUUUCCAGGCUCAU | 645 |
| 3925 AAAACCUUUGAAGAACUUU | 219 | 3925 AAAACCUUUGAAGAACUUU | 219 | 3943 AAAGUUCUUCAAAGGUUUU | 646 |
| 3943 UUACCGAAUGCCACCUCCA | 220 | 3943 UUACCGAAUGCCACCUCCA | 220 | 3961 UGGAGGUGGCAUUCGGUAA | 647 |
| 3961 AUGUUUGAUGACUACCAGG | 221 | 3961 AUGUUUGAUGACUACCAGG | 221 | 3979 CCUGGUAGUCAUCAAACAU | 648 |
| 3979 GGCGACAGCAGCACUCUGU | 222 | 3979 GGCGACAGCAGCACUCUGU | 222 | 3997 ACAGAGUGCUGCUGUCGCC | 649 |
| 3997 UUGGCCUCUCCCAUGCUGA | 223 | 3997 UUGGCCUCUCCCAUGCUGA | 223 | 4015 UCAGCAUGGGAGAGGCCAA | 650 |
| 4015 AAGCGCUUCACCUGGACUG | 224 | 4015 AAGCGCUUCACCUGGACUG | 224 | 4033 CAGUCCAGGUGAAGCGCUU | 651 |
| 4033 GACAGCAAACCCAAGGCCU | 225 | 4033 GACAGCAAACCCAAGGCCU | 225 | 4051 AGGCCUUGGGUUUGCUGUC | 652 |
| 4051 UCGCUCAAGAUUGACUUGA | 226 | 4051 UCGCUCAAGAUUGACUUGA | 226 | 4069 UCAAGUCAAUCUUGAGCGA | 653 |
| 4069 AGAGUAACCAGUAAAAGUA | 227 | 4069 AGAGUAACCAGUAAAAGUA | 227 | 4087 UACUUUUACUGGUUACUCU | 654 |
| 4087 AAGGAGUCGGGGCUGUCUG | 228 | 4087 AAGGAGUCGGGGCUGUCUG | 228 | 4105 CAGACAGCCCCGACUCCUU | 655 |
| 4105 GAUGUCAGCAGGCCCAGUU | 229 | 4105 GAUGUCAGCAGGCCCAGUU | 229 | 4123 AACUGGGCCUGCUGACAUC | 656 |
| 4123 UUCUGCCAUUCCAGCUGUG | 230 | 4123 UUCUGCCAUUCCAGCUGUG | 230 | 4141 CACAGCUGGAAUGGCAGAA | 657 |
| 4141 GGGCACGUCAGCGAAGGCA | 231 | 4141 GGGCACGUCAGCGAAGGCA | 231 | 4159 UGCCUUCGCUGACGUGCCC | 658 |
| 4159 AAGCGCAGGUUCACCUACG | 232 | 4159 AAGCGCAGGUUCACCUACG | 232 | 4177 CGUAGGUGAACCUGCGCUU | 659 |
| 4177 GACCACGCUGAGCUGGAAA | 233 | 4177 GACCACGCUGAGCUGGAAA | 233 | 4195 UUUCCAGCUCAGCGUGGUC | 660 |
| 4195 AGGAAAAUCGCGUGCUGCU | 234 | 4195 AGGAAAAUCGCGUGCUGCU | 234 | 4213 AGCAGCACGCGAUUUUCCU | 661 |
| 4213 UCCCCGCCCCAGACUACA | 235 | 4213 UCCCCGCCCCAGACUACA | 235 | 4231 UGUAGUCUGGGGGCGGGGA | 662 |
| 4231 AACUCGGUGGUCCUGUACU | 236 | 4231 AACUCGGUGGUCCUGUACU | 236 | 4249 AGUACAGGACCACCGAGUU | 663 |
| 4249 UCCACCCCACCCAUCUAGA | 237 | 4249 UCCACCCCACCCAUCUAGA | 237 | 4267 UCUAGAUGGGUGGGGUGGA | 664 |
| 4267 AGUUUGACACGAAGCCUUA | 238 | 4267 AGUUUGACACGAAGCCUUA | 238 | 4285 UAAGGCUUCGUGUCAAACU | 665 |
| 4285 AUUUCUAGAAGCACAUGUG | 239 | 4285 AUUUCUAGAAGCACAUGUG | 239 | 4303 CACAUGUGCUUCUAGAAAU | 666 |
| 4303 GUAUUUAUACCCCCAGGAA | 240 | 4303 GUAUUUAUACCCCCAGGAA | 240 | 4321 UUCCUGGGGGUAUAAAUAC | 667 |
| 4321 AACUAGCUUUUGCCAGUAU | 241 | 4321 AACUAGCUUUUGCCAGUAU | 241 | 4339 AUACUGGCAAAAGCUAGUU | 668 |
| 4339 UUAUGCAUAUAUAAGUUUA | 242 | 4339 UUAUGCAUAUAUAAGUUUA | 242 | 4357 UAAACUUAUAUAUGCAUAA | 669 |
| 4357 ACACCUUUAUCUUUCCAUG | 243 | 4357 ACACCUUUAUCUUUCCAUG | 243 | 4375 CAUGGAAAGAUAAAGGUGU | 670 |
| 4375 GGGAGCCAGCUGCUUUUUG | 244 | 4375 GGGAGCCAGCUGCUUUUUG | 244 | 4393 CAAAAAGCAGCUGGCUCCC | 671 |
| 4393 GUGAUUUUUUUAAUAGUGC | 245 | 4393 GUGAUUUUUUUAAUAGUGC | 245 | 4411 GCACUAUUAAAAAAAUCAC | 672 |
| 4411 CUUUUUUUUUUUGACUAAC | 246 | 4411 CUUUUUUUUUUUGACUAAC | 246 | 4429 GUUAGUCAAAAAAAAAAAG | 673 |
| 4429 CAAGAAUGUAACUCCAGAU | 247 | 4429 CAAGAAUGUAACUCCAGAU | 247 | 4447 AUCUGGAGUUACAUUCUUG | 674 |
| 4447 UAGAGAAAUAGUGACAAGU | 248 | 4447 UAGAGAAAUAGUGACAAGU | 248 | 4465 ACUUGUCACUAUUUCUCUA | 675 |
| 4465 UGAAGAACACUACUGCUAA | 249 | 4465 UGAAGAACACUACUGCUAA | 249 | 4483 UUAGCAGUAGUGUUCUUCA | 676 |
| 4483 AAUCCUCAUGUUACUCAGU | 250 | 4483 AAUCCUCAUGUUACUCAGU | 250 | 4501 ACUGAGUAACAUGAGGAUU | 677 |
| 4501 UGUUAGAGAAAUCCUUCCU | 251 | 4501 UGUUAGAGAAAUCCUUCCU | 251 | 4519 AGGAAGGAUUUCUCUAACA | 678 |
| 4519 UAAACCCAAUGACUUCCCU | 252 | 4519 UAAACCCAAUGACUUCCCU | 252 | 4537 AGGGAAGUCAUUGGGUUUA | 679 |
| 4537 UGCUCCAACCCCCGCCACC | 253 | 4537 UGCUCCAACCCCCGCCACC | 253 | 4555 GGUGGCGGGGGUUGGAGCA | 680 |
| 4555 CUCAGGGCACGCAGGACCA | 254 | 4555 CUCAGGGCACGCAGGACCA | 254 | 4573 UGGUCCUGCGUGCCCUGAG | 681 |
| 4573 AGUUUGAUUGAGGAGCUGC | 255 | 4573 AGUUUGAUUGAGGAGCUGC | 255 | 4591 GCAGCUCCUCAAUCAAACU | 682 |
| 4591 CACUGAUCACCCAAUGCAU | 256 | 4591 CACUGAUCACCCAAUGCAU | 256 | 4609 AUGCAUUGGGUGAUCAGUG | 683 |
| 4609 UCACGUACCCCACUGGGCC | 257 | 4609 UCACGUACCCCACUGGGCC | 257 | 4627 GGCCCAGUGGGGUACGUGA | 684 |
| 4627 CAGCCCUGCAGCCCAAAAC | 258 | 4627 CAGCCCUGCAGCCCAAAAC | 258 | 4645 GUUUUGGGCUGCAGGGCUG | 685 |
| 4645 CCCAGGGCAACAAGCCCGU | 259 | 4645 CCCAGGGCAACAAGCCCGU | 259 | 4663 ACGGGCUUGUUGCCCUGGG | 686 |
| 4663 UUAGCCCCAGGGGAUCACU | 260 | 4663 UUAGCCCCAGGGGAUCACU | 260 | 4681 AGUGAUCCCCUGGGGCUAA | 687 |
| 4681 UGGCUGGCCUGAGCAACAU | 261 | 4681 UGGCUGGCCUGAGCAACAU | 261 | 4699 AUGUUGCUCAGGCCAGCCA | 688 |
| 4699 UCUCGGGAGUCCUCUAGCA | 262 | 4699 UCUCGGGAGUCCUCUAGCA | 262 | 4717 UGCUAGAGGACUCCCGAGA | 689 |
| 4717 AGGCGUAAGACAUGUGAGG | 263 | 4717 AGGCGUAAGACAUGUGAGG | 263 | 4735 CCUCACAUGUCUUAGGCCU | 690 |
| 4735 GAGGAAAAGGAAAAAAAGC | 264 | 4735 GAGGAAAAGGAAAAAAAGC | 264 | 4753 GCUUUUUUUCCUUUUCCUC | 691 |
| 4753 CAAAAAGCAAGGGAGAAAA | 265 | 4753 CAAAAAGCAAGGGAGAAAA | 265 | 4771 UUUUCUCCCUUGCUUUUUG | 692 |
| 4771 AGAGAAACCGGGAGAAGGC | 266 | 4771 AGAGAAACCGGGAGAAGGC | 266 | 4789 GCCUUCUCCCGGUUUCUCU | 693 |
| 4789 CAUGAGAAAGAAUUUGAGA | 267 | 4789 CAUGAGAAAGAAUUUGAGA | 267 | 4807 UCUCAAAUUCUUUCUCAUG | 694 |
| 4807 ACGCACCAUGUGGGCACGG | 268 | 4807 ACGCACCAUGUGGGCACGG | 268 | 4825 CCGUGCCCACAUGGUGCGU | 695 |
| 4825 GAGGGGGACGGGGCUCAGC | 269 | 4825 GAGGGGGACGGGGCUCAGC | 269 | 4843 GCUGAGCCCCGUCCCCCUC | 696 |
| 4843 CAAUGCCAUUUCAGUGGCU | 270 | 4843 CAAUGCCAUUUCAGUGGCU | 270 | 4861 AGCCACUGAAAUGGCAUUG | 697 |
| 4861 UUCCCAGCUCUGACCCUUC | 271 | 4861 UUCCCAGCUCUGACCCUUC | 271 | 4879 GAAGGGUCAGAGCUGGGAA | 698 |
| 4879 CUACAUUUGAGGGCCCAGC | 272 | 4879 CUACAUUUGAGGGCCCAGC | 272 | 4897 GCUGGGCCCUCAAAUGUAG | 699 |
| 4897 CCAGGAGCAGAUGGACAGC | 273 | 4897 CCAGGAGCAGAUGGACAGC | 273 | 4915 GCUGUCCAUCUGCUCCUGG | 700 |
| 4915 CGAUGAGGGGACAUUUUCU | 274 | 4915 CGAUGAGGGGACAUUUUCU | 274 | 4933 AGAAAAUGUCCCCUCACG | 701 |
| 4933 UGGAUUCUGGGAGGCAAGA | 275 | 4933 UGGAUUCUGGGAGGCAAGA | 275 | 4951 UCUUGCCUCCCAGAAUCCA | 702 |
| 4951 AAAAGGACAAAUAUCUUUU | 276 | 4951 AAAAGGACAAAUAUCUUUU | 276 | 4969 AAAAGAUAUUUGUCCUUUU | 703 |
| 4969 UUGGAACUAAAGCAAAUU | 277 | 4969 UUGGAACUAAAGCAAAUU | 277 | 4987 AAUUUGCUUUAGUUCCAA | 704 |
| 4987 UUUAGACCUUUACCUAUGG | 278 | 4987 UUUAGACCUUUACCUAUGG | 278 | 5005 CCAUAGGUAAAGGUCUAAA | 705 |
| 5005 GAAGUGGUUCUAUGUCCAU | 279 | 5005 GAAGUGGUUCUAUGUCCAU | 279 | 5023 AUGGACAUAGAACCACUUC | 706 |
| 5023 UUCUCAUUCUGUGGCAUGUU | 280 | 5023 UUCUCAUUCUGUGGCAUGUU | 280 | 5041 AACAUGCCACGAAUGAGAA | 707 |
| 5041 UUUGAUUGUAGCACUGAG | 281 | 5041 UUUGAUUGUAGCACUGAG | 281 | 5059 CUCAGUGCUACAAAUCAAA | 708 |
| 5059 GGGUGGCACUCAACUCUGA | 282 | 5059 GGGUGGCACUCAACUCUGA | 282 | 5077 UCAGAGUUGAGUGCCACCC | 709 |
| 5077 AGCCCAUACUUUUGGGCUCC | 283 | 5077 AGCCCAUACUUUUGGGCUCC | 283 | 5095 GGAGCCAAAAGUAUGGGCU | 710 |
| 5095 CUCUAGUAAGAUGCACUGA | 284 | 5095 CUCUAGUAAGAUGCACUGA | 284 | 5113 UCAGUGCAUCUUACUAGAG | 711 |
| 5113 AAAACUAGCCAGAGUUAG | 285 | 5113 AAAACUAGCCAGAGUUAG | 285 | 5131 CUAACUCUGGCUAGUUUU | 712 |
| 5131 GGUUGUCUCCAGGCCAUGA | 286 | 5131 GGUUGUCUCCAGGCCAUGA | 286 | 5149 UCAUGGCCUGGAGACAACC | 713 |
| 5149 AUGGCCUUACACUGAAAAU | 287 | 5149 AUGGCCUUACACUGAAAAU | 287 | 5167 AUUUUCAGUGUAAGGCCAU | 714 |
| 5167 UGUCACAUUCUAUUUUGGG | 288 | 5167 UGUCACAUUCUAUUUUGGG | 288 | 5185 CCCAAAAUAGAAUGUGACA | 715 |

TABLE II-continued

VEGF and/or VEGFR siNA AND TARGET SEQUENCES

| | | | | | | | |
|---|---|---|---|---|---|---|---|
| 5185 | GUAUUAAUAUAUAGUCCAG | 289 | 5185 | GUAUUAAUAUAUAGUCCAG | 289 | 5203 CUGGACUAUAUAUUAAUAC | 716 |
| 5203 | GACACUUAACUCAAUUUCU | 290 | 5203 | GACACUUAACUCAAUUUCU | 290 | 5221 AGAAAUUGAGUUAAGUGUC | 717 |
| 5221 | UUGGUAUUAUUCUGUUUUG | 291 | 5221 | UUGGUAUUAUUCUGUUUUG | 291 | 5239 CAAAACAGAAUAAUACCAA | 718 |
| 5239 | GCACAGUUAGUUGUGAAAG | 292 | 5239 | GCACAGUUAGUUGUGAAAG | 292 | 5257 CUUUCACAACUAACUGUGC | 719 |
| 5257 | GAAAGCUGAGAAGAAUGAA | 293 | 5257 | GAAAGCUGAGAAGAAUGAA | 293 | 5275 UUCAUUCUUCUCAGCUUUC | 720 |
| 5275 | AAAUGCAGUCCUGAGGAGA | 294 | 5275 | AAAUGCAGUCCUGAGGAGA | 294 | 5293 UCUCCUCAGGACUGCAUUU | 721 |
| 5293 | AGUUUUCUCCAUAUCAAAA | 295 | 5293 | AGUUUUCUCCAUAUCAAAA | 295 | 5311 UUUUGAUAUGGAGAAAACU | 722 |
| 5311 | ACGAGGGCUGAUGGAGGAA | 296 | 5311 | ACGAGGGCUGAUGGAGGAA | 296 | 5329 UUCCUCCAUCAGCCCUCGU | 723 |
| 5329 | AAAAGGUCAAUAAGGUCAA | 297 | 5329 | AAAAGGUCAAUAAGGUCAA | 297 | 5347 UUGACCUUAUUGACCUUUU | 724 |
| 5347 | AGGGAAGACCCCGUCUCUA | 298 | 5347 | AGGGAAGACCCCGUCUCUA | 298 | 5365 UAGAGACGGGGUCUUCCCU | 725 |
| 5365 | AUACCAACCAAACCAAUUC | 299 | 5365 | AUACCAACCAAACCAAUUC | 299 | 5383 GAAUUGGUUUGGUUGGUAU | 726 |
| 5383 | CACCAACACAGUUGGGACC | 300 | 5383 | CACCAACACAGUUGGGACC | 300 | 5401 GGUCCCAACUGUGUUGGUG | 727 |
| 5401 | CCAAAACACAGGAAGUCAG | 301 | 5401 | CCAAAACACAGGAAGUCAG | 301 | 5419 CUGACUUCCUGUGUUUUGG | 728 |
| 5419 | GUCACGUUUCCUUUUCAUU | 302 | 5419 | GUCACGUUUCCUUUUCAUU | 302 | 5437 AAUGAAAAGGAAACGUGAC | 729 |
| 5437 | UUAAUGGGGAUUCCACUAU | 303 | 5437 | UUAAUGGGGAUUCCACUAU | 303 | 5455 AUAGUGGAAUCCCCAUUAA | 730 |
| 5455 | UCUCACACUAAUCUGAAAG | 304 | 5455 | UCUCACACUAAUCUGAAAG | 304 | 5473 CUUUCAGAUUAGUGUGAGA | 731 |
| 5473 | GGAUGUGGAAGAGCAUUAG | 305 | 5473 | GGAUGUGGAAGAGCAUUAG | 305 | 5491 CUAAUGCUCUUCCACAUCC | 732 |
| 5491 | GCUGGCGCAUAUUAAGCAC | 306 | 5491 | GCUGGCGCAUAUUAAGCAC | 306 | 5509 GUGCUUAAUAUGCGCCAGC | 733 |
| 5509 | CUUUAAGCUCCUUGAGUAA | 307 | 5509 | CUUUAAGCUCCUUGAGUAA | 307 | 5527 UUACUCAAGGAGCUUAAAG | 734 |
| 5527 | AAAAGGUGGUAUGUAAUUU | 308 | 5527 | AAAAGGUGGUAUGUAAUUU | 308 | 5545 AAAUUACAUACCACCUUUU | 735 |
| 5545 | UAUGCAAGGUAUUUCUCCA | 309 | 5545 | UAUGCAAGGUAUUUCUCCA | 309 | 5563 UGGAGAAAUACCUUGCAUA | 736 |
| 5563 | AGUUGGGACUCAGGAUAUU | 310 | 5563 | AGUUGGGACUCAGGAUAUU | 310 | 5581 AAUAUCCUGAGUCCCAACU | 737 |
| 5581 | UAGUUAAUGAGCCAUCACU | 311 | 5581 | UAGUUAAUGAGCCAUCACU | 311 | 5599 AGUGAUGGCUCAUUAACUA | 735 |
| 5599 | UAGAAGAAAAGCCCAUUUU | 312 | 5599 | UAGAAGAAAAGCCCAUUUU | 312 | 5617 AAAAUGGGCUUUUCUUCUA | 739 |
| 5617 | UCAACUGCUUUGAAACUUG | 313 | 5617 | UCAACUGCUUUGAAACUUG | 313 | 5635 CAAGUUUCAAAGCAGUUGA | 740 |
| 5635 | GCCUGGGGUCUGAGCAUGA | 314 | 5635 | GCCUGGGGUCUGAGCAUGA | 314 | 5653 UCAUGCUCAGACCCCAGGC | 741 |
| 5653 | AUGGGAAUAGGGAGACAGG | 315 | 5653 | AUGGGAAUAGGGAGACAGG | 315 | 5671 CCUGUCUCCCUAUUCCCAU | 742 |
| 5671 | GGUAGGAAAGGGCGCCUAC | 316 | 5671 | GGUAGGAAAGGGCGCCUAC | 316 | 5689 GUAGGCGCCCUUUCCUACC | 743 |
| 5689 | CUCUUCAGGGUCUAAAGAU | 317 | 5689 | CUCUUCAGGGUCUAAAGAU | 317 | 5707 AUCUUUAGACCCUGAAGAG | 744 |
| 5707 | UCAAGUGGGCCUUGGAUCG | 318 | 5707 | UCAAGUGGGCCUUGGAUCG | 318 | 5725 CGAUCCAAGGCCCACUUGA | 745 |
| 5725 | GCUAAGCUGGCUCUGUUUG | 319 | 5725 | GCUAAGCUGGCUCUGUUUG | 319 | 5743 CAAACAGAGCCAGCUUAGC | 746 |
| 5743 | GAUGCUAUUUAUGCAAGUU | 320 | 5743 | GAUGCUAUUUAUGCAAGUU | 320 | 5761 AACUUGCAUAAAUAGCAUC | 747 |
| 5761 | UAGGGUCUAUGUAUUUAGG | 321 | 5761 | UAGGGUCUAUGUAUUUAGG | 321 | 5779 CCUAAAUACAUAGACCCUA | 748 |
| 5779 | GAUGCGCCUACUCUUCAGG | 322 | 5779 | GAUGCGCCUACUCUUCAGG | 322 | 5797 CCUGAAGAGUAGGCGCAUC | 749 |
| 5797 | GGUCUAAAGACUCAAGUGGG | 323 | 5797 | GGUCUAAAGACUCAAGUGGG | 323 | 5815 CCCACUUGAGUCUUUAGACC | 750 |
| 5815 | GCCUUGGAUCGCUAAGCUG | 324 | 5815 | GCCUUGGAUCGCUAAGCUG | 324 | 5833 CAGCUUAGCGAUCCAAGGC | 751 |
| 5833 | GGCUCUGUUUGAUGCUAUU | 325 | 5833 | GGCUCUGUUUGAUGCUAUU | 325 | 5851 AAUAGCAUCAAACAGAGCC | 752 |
| 5851 | UUAUGCAAGUUAGGGUCUA | 326 | 5851 | UUAUGCAAGUUAGGGUCUA | 326 | 5869 UAGACCCUAACUUGCAUAA | 753 |
| 5869 | AUGUAUUUAGGAUGUCUGC | 327 | 5869 | AUGUAUUUAGGAUGUCUGC | 327 | 5887 GCAGACAUCCUAAAUACAU | 754 |
| 5887 | CACCUUCUGCAGCCAGUCA | 328 | 5887 | CACCUUCUGCAGCCAGUCA | 328 | 5905 UGACUGGCUGCAGAAGGUG | 755 |
| 5905 | AGAAGCUGGAGAGGCAACA | 329 | 5905 | AGAAGCUGGAGAGGCAACA | 329 | 5923 UGUUGCCUCUCCAGCUUCU | 756 |
| 5923 | AGUGGAUUGCUGCUUCUUG | 330 | 5923 | AGUGGAUUGCUGCUUCUUG | 330 | 5941 CAAGAAGCAGCAAUCCACU | 757 |
| 5941 | GGGGAGAAGAGUAUGCUUC | 331 | 5941 | GGGGAGAAGAGUAUGCUUC | 331 | 5959 GAAGCAUACUCUUCUCCCC | 758 |
| 5959 | CCUUUUAUCCAUGUAAUUU | 332 | 5959 | CCUUUUAUCCAUGUAAUUU | 332 | 5977 AAAUUACAUGGAUAAAAGG | 759 |
| 5977 | UAACUGUAGAACCUGAGCU | 333 | 5977 | UAACUGUAGAACCUGAGCU | 333 | 5995 AGCUCAGGUUCUACAGUUA | 760 |
| 5995 | UCUAAGUAACCGAAGAAUG | 334 | 5995 | UCUAAGUAACCGAAGAAUG | 334 | 6013 CAUUCUUCGGUUACUUAGA | 761 |
| 6013 | GUAUGCCUCUGUUCUUAUG | 335 | 6013 | GUAUGCCUCUGUUCUUAUG | 335 | 6031 CAUAAGAACAGAGGCAUAC | 762 |
| 6031 | GUGCCACAUCCUUGUUUAA | 336 | 6031 | GUGCCACAUCCUUGUUUAA | 336 | 6049 UUAAACAAGGAUGUGGCAC | 763 |
| 6049 | AAGGCUCUCUGUAUGAAGA | 337 | 6049 | AAGGCUCUCUGUAUGAAGA | 337 | 6067 UCUUCAUACAGAGAGCCUU | 764 |
| 6067 | AGAUGGGACCGUCAUCAGC | 338 | 6067 | AGAUGGGACCGUCAUCAGC | 338 | 6085 GCUGAUGACGGUCCCAUCU | 765 |
| 6085 | CACAUUCCCUAGUGAGCCU | 339 | 6085 | CACAUUCCCUAGUGAGCCU | 339 | 6103 AGGCUCACUAGGGAAUGUG | 766 |
| 6103 | UACUGGCUCCUGGCAGCGG | 340 | 6103 | UACUGGCUCCUGGCAGCGG | 340 | 6121 CCGCUGCCAGGAGCCAGUA | 767 |
| 6121 | GCUUUUGUGGAAGACUCAC | 341 | 6121 | GCUUUUGUGGAAGACUCAC | 341 | 6139 GUGAGUCUUCCACAAAAGC | 768 |
| 6139 | CUAGCCAGAAGAGAGGAGU | 342 | 6139 | CUAGCCAGAAGAGAGGAGU | 342 | 6157 ACUCCUCUCUUCUGGCUAG | 769 |
| 6157 | UGGGACAGUCCUCUCCACC | 343 | 6157 | UGGGACAGUCCUCUCCACC | 343 | 6175 GGUGGAGAGGACUGUCCCA | 770 |
| 6175 | CAAGAUCUAAAUCCAAACA | 344 | 6175 | CAAGAUCUAAAUCCAAACA | 344 | 6193 UGUUUGGAUUUAGAUCUUG | 771 |
| 6193 | AAAAGCAGGCUAGAGCCAG | 345 | 6193 | AAAAGCAGGCUAGAGCCAG | 345 | 6211 CUGGCUCUAGCCUGCUUUU | 772 |
| 6211 | GAAGAGAGGACAAAUCUUU | 346 | 6211 | GAAGAGAGGACAAAUCUUU | 346 | 6229 AAAGAUUUGUCCUCUCUUC | 773 |
| 6229 | UGUUGUUCCUCUUCUUUAC | 347 | 6229 | UGUUGUUCCUCUUCUUUAC | 347 | 6247 GUAAAGAAGAGGAACAACA | 774 |
| 6247 | CACAUACGCAAACCACCUG | 348 | 6247 | CACAUACGCAAACCACCUG | 348 | 6265 CAGGUGGUUUGCGUAUGUG | 775 |
| 6265 | GUGACAGCUGGCAAUUUUA | 349 | 6265 | GUGACAGCUGGCAAUUUUA | 349 | 6283 UAAAAUUGCCAGCUGUCAC | 776 |
| 6283 | AUAAAUCAGGUAACUGGAA | 350 | 6283 | AUAAAUCAGGUAACUGGAA | 350 | 6301 UUCCAGUUACCUGAUUUAU | 777 |
| 6301 | AGGAGGUUAAACUCAGAAA | 351 | 6301 | AGGAGGUUAAACUCAGAAA | 351 | 6319 UUUCUGAGUUUAACCUCCU | 778 |
| 6319 | AAAAGAAGACCUCAGUCAG | 352 | 6319 | AAAAGAAGACCUCAGUCAG | 352 | 6337 CUGACUGAGGUCUUCUUUU | 779 |
| 6337 | AUUCUCUACUUUUUUUUUU | 353 | 6337 | AUUCUCUACUUUUUUUUUU | 353 | 6355 AAAAAAAAAAGUAGAGAAU | 780 |
| 6355 | UUUUUUUCCAAAUCAGAUA | 354 | 6355 | UUUUUUUCCAAAUCAGAUA | 354 | 6373 UAUCUGAUUUGGAAAAAAA | 781 |
| 6373 | AAUAGCCCAGCAAAUAGUG | 355 | 6373 | AAUAGCCCAGCAAAUAGUG | 355 | 6391 CACUAUUUGCUGGGCUAUU | 782 |
| 6391 | GAUAACAAAUAAAACCUUA | 356 | 6391 | GAUAACAAAUAAAACCUUA | 356 | 6409 UAAGGUUUUAUUUGUUAUC | 783 |
| 6409 | AGCUGUUCAUGUCUUGAUU | 357 | 6409 | AGCUGUUCAUGUCUUGAUU | 357 | 6427 AAUCAAGACAUGAACAGCU | 784 |
| 6427 | UUCAAUAAUUAUUCUAA | 358 | 6427 | UUCAAUAAUUAUUCUAA | 358 | 6445 UUAAGAAUUAAUUAUUGAA | 785 |
| 6445 | AUCAUUAAGAGACCAUAAU | 359 | 6445 | AUCAUUAAGAGACCAUAAU | 359 | 6463 AUUAUGGUCUCUUAAUGAU | 786 |
| 6463 | UAAAAUACUCCUUUUCAAGA | 360 | 6463 | UAAAAUACUCCUUUUCAAGA | 360 | 6481 UCUUGAAAAAGGAGUAUUUA | 787 |
| 6481 | AGAAAAGCAAAACCAUUAG | 361 | 6481 | AGAAAAGCAAAACCAUUAG | 361 | 6499 CUAAUGGUUUUGCUUUUCU | 788 |
| 6499 | GAAUUGUUACUCAGCUCCU | 362 | 6499 | GAAUUGUUACUCAGCUCCU | 362 | 6517 AGGAGCUGAGUAACAAUUC | 789 |
| 6517 | UUCAAACUCAGGUUUGUAG | 363 | 6517 | UUCAAACUCAGGUUUGUAG | 363 | 6535 CUACAAACCUGAGUUUGAA | 790 |
| 6535 | GCAUACAUGAGUCCAUCCA | 364 | 6535 | GCAUACAUGAGUCCAUCCA | 364 | 6553 UGGAUGGACUCAUGUAUGC | 791 |
| 6553 | AUCAGUCAAAGAAUGGUUC | 365 | 6553 | AUCAGUCAAAGAAUGGUUC | 365 | 6571 GAACCAUUCUUUGACUGAU | 792 |

TABLE II-continued

VEGF and/or VEGFR siNA AND TARGET SEQUENCES

| | | | | | | | | |
|---|---|---|---|---|---|---|---|---|
| 6571 | CCAUCUGGAGUCUUAAUGU | 366 | 6571 | CCAUCUGGAGUCUUAAUGU | 366 | 6589 | ACAUUAAGACUCCAGAUGG | 793 |
| 6589 | UAGAAAGAAAAAUGGAGAC | 367 | 6589 | UAGAAAGAAAAAUGGAGAC | 367 | 6607 | GUCUCCAUUUUUCUUUCUA | 794 |
| 6607 | CUUGUAAUAAUGAGCUAGU | 368 | 6607 | CUUGUAAUAAUGAGCUAGU | 368 | 6625 | ACUAGCUCAUUAUUACAAG | 795 |
| 6625 | UUACAAAGUGCUUGUUCAU | 369 | 6625 | UUACAAAGUGCUUGUUCAU | 369 | 6643 | AUGAACAAGCACUUUGUAA | 796 |
| 6643 | UUAAAAUAGCACUGAAAAU | 370 | 6643 | UUAAAAUAGCACUGAAAAU | 370 | 6661 | AUUUUCAGUGCUAUUUUAA | 797 |
| 6661 | UUGAAACAUGAAUUAACUG | 371 | 6661 | UUGAAACAUGAAUUAACUG | 371 | 6679 | CAGUUAAUUCAUGUUUCAA | 798 |
| 6679 | GAUAAUAUUCCAAUCAUUU | 372 | 6679 | GAUAAUAUUCCAAUCAUUU | 372 | 6697 | AAAUGAUUGGAAUAUUAUC | 799 |
| 6697 | UGCCAUUUAUGACAAAAAU | 373 | 6697 | UGCCAUUUAUGACAAAAAU | 373 | 6715 | AUUUUGUCAUAAAUGGCA | 800 |
| 6715 | UGGUUGGCACUAACAAAGA | 374 | 6715 | UGGUUGGCACUAACAAAGA | 374 | 6733 | UCUUUGUUAGUGCCAACCA | 801 |
| 6733 | AACGAGCACUUCCUUUCAG | 375 | 6733 | AACGAGCACUUCCUUUCAG | 375 | 6751 | CUGAAAGGAAGUGCUCGUU | 802 |
| 6751 | GAGUUUCUGAGAUAAUGUA | 376 | 6751 | GAGUUUCUGAGAUAAUGUA | 376 | 6769 | UACAUUAUCUCAGAAACUC | 803 |
| 6769 | ACGUGGAACAGUCUGGGUG | 377 | 6769 | ACGUGGAACAGUCUGGGUG | 377 | 6787 | CACCCAGACUGUUCCACGU | 804 |
| 6787 | GGAAUGGGGCUGAAACCAU | 378 | 6787 | GGAAUGGGGCUGAAACCAU | 378 | 6805 | AUGGUUUCAGCCCCAUUCC | 805 |
| 6805 | UGUGCAAGUCUGUGUCUUG | 379 | 6805 | UGUGCAAGUCUGUGUCUUG | 379 | 6823 | CAAGACACAGACUUGCACA | 806 |
| 6823 | GUCAGUCCAAGAAGUGACA | 380 | 6823 | GUCAGUCCAAGAAGUGACA | 380 | 6841 | UGUCACUUCUUGGACUGAC | 807 |
| 6841 | ACCGAGAUGUUAAUUUUAG | 381 | 6841 | ACCGAGAUGUUAAUUUUAG | 381 | 6859 | CUAAAAUUAACAUCUCGGU | 808 |
| 6859 | GGGACCCGUGCCUUGUUUC | 382 | 6859 | GGGACCCGUGCCUUGUUUC | 382 | 6877 | GAAACAAGGCACGGGUCCC | 809 |
| 6877 | CCUAGCCCACAAGAAUGCA | 383 | 6877 | CCUAGCCCACAAGAAUGCA | 383 | 6895 | UGCAUUCUUGUGGGCUAGG | 810 |
| 6895 | AAACAUCAAACAGAUACUC | 384 | 6895 | AAACAUCAAACAGAUACUC | 384 | 6913 | GAGUAUCUGUUUGAUGUUU | 811 |
| 6913 | CGCUAGCCUCAUUUAAAUU | 385 | 6913 | CGCUAGCCUCAUUUAAAUU | 385 | 6931 | AAUUUAAAUGAGGCUAGCG | 812 |
| 6931 | UGAUUAAAGGAGGAGUGCA | 386 | 6931 | UGAUUAAAGGAGGAGUGCA | 386 | 6949 | UGCACUCCUCCUUUAAUCA | 813 |
| 6949 | AUCUUUGGCCGACAGUGGU | 387 | 6949 | AUCUUUGGCCGACAGUGGU | 387 | 6967 | ACCACUGUCGGCCAAAGAU | 814 |
| 6967 | UGUAACUGUGUGUGUGUGU | 388 | 6967 | UGUAACUGUGUGUGUGUGU | 388 | 6985 | ACACACACACACAGUUACA | 815 |
| 6985 | UGUGUGUGUGUGUGUGUGU | 389 | 6985 | UGUGUGUGUGUGUGUGUGU | 389 | 7003 | ACACACACACACACACACA | 816 |
| 7003 | UGUGUGUGUGUGGGUGUGG | 390 | 7003 | UGUGUGUGUGUGGGUGUGG | 390 | 7021 | CCACACCCACACACACACA | 817 |
| 7021 | GGUGUAUGUGUGUUUUGUG | 391 | 7021 | GGUGUAUGUGUGUUUUGUG | 391 | 7039 | CACAAAACACACAUACACC | 818 |
| 7039 | GCAUAACUAUUUAAGGAAA | 392 | 7039 | GCAUAACUAUUUAAGGAAA | 392 | 7057 | UUUCCUUAAAUAGUUAUGC | 819 |
| 7057 | ACUGGAAUUUUAAAGUUAC | 393 | 7057 | ACUGGAAUUUUAAAGUUAC | 393 | 7075 | GUAACUUUAAAAUUCCAGU | 820 |
| 7075 | CUUUUAUACAAACCAAGAA | 394 | 7075 | CUUUUAUACAAACCAAGAA | 394 | 7093 | UUCUUGGUUUGUAUAAAAG | 821 |
| 7093 | AUAUAUGCUACAGAUAUAA | 395 | 7093 | AUAUAUGCUACAGAUAUAA | 395 | 7111 | UUAUAUCUGUAGCAUAUAU | 822 |
| 7111 | AGACAGACAUGGUUUGGUC | 396 | 7111 | AGACAGACAUGGUUUGGUC | 396 | 7129 | GACCAAACCAUGUCUGUCU | 823 |
| 7129 | CCUAUAUUUCUAGUCAUGA | 397 | 7129 | CCUAUAUUUCUAGUCAUGA | 397 | 7147 | UCAUGACUAGAAAUAUAGG | 824 |
| 7147 | AUGAAUGUAUUUUGUAUAC | 398 | 7147 | AUGAAUGUAUUUUGUAUAC | 398 | 7165 | GUAUACAAAAUACAUUCAU | 825 |
| 7165 | CCAUCUUCAUAUAAUAUAC | 399 | 7165 | CCAUCUUCAUAUAAUAUAC | 399 | 7183 | GUAUAUUAUAUGAAGAUGG | 826 |
| 7183 | CUUAAAAAUAUUUCUUAAU | 400 | 7183 | CUUAAAAAUAUUUCUUAAU | 400 | 7201 | AUUAAGAAAUAUUUUUAAG | 827 |
| 7201 | UUGGGAUUUGUAAUCGUAC | 401 | 7201 | UUGGGAUUUGUAAUCGUAC | 401 | 7219 | GUACGAUUACAAAUCCCAA | 828 |
| 7219 | CCAACUUAAUUGAUAAACU | 402 | 7219 | CCAACUUAAUUGAUAAACU | 402 | 7237 | AGUUUAUCAAUUAAGUUGG | 829 |
| 7237 | UUGGCAACUGCUUUUAUGU | 403 | 7237 | UUGGCAACUGCUUUUAUGU | 403 | 7255 | ACAUAAAAGCAGUUGCCAA | 830 |
| 7255 | UUCUGUCUCCUUCCAUAAA | 404 | 7255 | UUCUGUCUCCUUCCAUAAA | 404 | 7273 | UUUAUGGAAGGAGACAGAA | 831 |
| 7273 | AUUUUUCAAAAUACUAAUU | 405 | 7273 | AUUUUUCAAAAUACUAAUU | 405 | 7291 | AAUUAGUAUUUUGAAAAAU | 832 |
| 7291 | UCAACAAAGAAAAAGCUCU | 406 | 7291 | UCAACAAAGAAAAAGCUCU | 406 | 7309 | AGAGCUUUUUCUUUGUUGA | 833 |
| 7309 | UUUUUUUUCCUAAAAUAAA | 407 | 7309 | UUUUUUUUCCUAAAAUAAA | 407 | 7327 | UUUAUUUUAGGAAAAAAAA | 834 |
| 7327 | ACUCAAAAUUUAUCCUUGUU | 408 | 7327 | ACUCAAAAUUUAUCCUUGUU | 408 | 7345 | AACAAGGAUAAAAUUUGAGU | 835 |
| 7345 | UUAGAGCAGAGAAAAAUUA | 409 | 7345 | UUAGAGCAGAGAAAAAUUA | 409 | 7363 | UAAUUUUUCUCUGCUCUAA | 836 |
| 7363 | AAGAAAAACUUUGAAAUGG | 410 | 7363 | AAGAAAAACUUUGAAAUGG | 410 | 7381 | CCAUUUCAAAGUUUUUCUU | 837 |
| 7381 | GUCUCAAAAAAUUGCUAAA | 411 | 7381 | GUCUCAAAAAAUUGCUAAA | 411 | 7399 | UUUAGCAAUUUUUUGAGAC | 838 |
| 7399 | AUAUUUUCAAUGGAAAACU | 412 | 7399 | AUAUUUUCAAUGGAAAACU | 412 | 7417 | AGUUUUCCAUUGAAAAUAU | 839 |
| 7417 | UAAAUGUUAGUUUAGCUGA | 413 | 7417 | UAAAUGUUAGUUUAGCUGA | 413 | 7435 | UCAGCUAAACUAACAUUUA | 840 |
| 7435 | AUUGUAUGGGGUUUUCGAA | 414 | 7435 | AUUGUAUGGGGUUUUCGAA | 414 | 7453 | UUCGAAAACCCCAUACAAU | 841 |
| 7453 | ACCUUUCACUUUUUGUUUG | 415 | 7453 | ACCUUUCACUUUUUGUUUG | 415 | 7471 | CAAACAAAAAGUGAAAGGU | 842 |
| 7471 | GUUUUACCUAUUUCACAC | 416 | 7471 | GUUUUACCUAUUUCACAC | 416 | 7489 | GUUGUGAAAUAGGUAAAAC | 843 |
| 7489 | CUGUGUAAAUUGCCAAUAA | 417 | 7489 | CUGUGUAAAUUGCCAAUAA | 417 | 7507 | UUAUUGGCAAUUUACACAG | 844 |
| 7507 | AUUCCUGUCCAUGAAAAUG | 418 | 7507 | AUUCCUGUCCAUGAAAAUG | 418 | 7525 | CAUUUUCAUGGACAGGAAU | 845 |
| 7525 | GCAAAUUAUCCAGUGUAGA | 419 | 7525 | GCAAAUUAUCCAGUGUAGA | 419 | 7543 | UCUACACUGGAUAAUUUGC | 846 |
| 7543 | AUAUAUUUGACCAUCACCC | 420 | 7543 | AUAUAUUUGACCAUCACCC | 420 | 7561 | GGGUGAUGGUCAAAUAUAU | 847 |
| 7561 | CUAUGGAUAUUGGCUAGUU | 421 | 7561 | CUAUGGAUAUUGGCUAGUU | 421 | 7579 | AACUAGCCAAUAUCCAUAG | 848 |
| 7579 | UUUGCCUUUAUUAAGCAAA | 422 | 7579 | UUUGCCUUUAUUAAGCAAA | 422 | 7597 | UUUGCUUAAUAAAGGCAAA | 849 |
| 7597 | AUUCAUUUCAGCCUGAAUG | 423 | 7597 | AUUCAUUUCAGCCUGAAUG | 423 | 7615 | CAUUCAGGCUGAAAUGAAU | 850 |
| 7615 | GUCUGCCUAUAUAUUCUCU | 424 | 7615 | GUCUGCCUAUAUAUUCUCU | 424 | 7633 | AGAGAAUAUAUAGGCAGAC | 851 |
| 7633 | UGCUCUUUGUAUUCUCCUU | 425 | 7633 | UGCUCUUUGUAUUCUCCUU | 425 | 7651 | AAGGAGAAUACAAAGAGCA | 852 |
| 7651 | UUGAACCCGUUAAAACAUC | 426 | 7651 | UUGAACCCGUUAAAACAUC | 426 | 7669 | GAUGUUUUAACGGGUUCAA | 853 |
| 7662 | AAAACAUCCUGUGGCACUC | 427 | 7662 | AAAACAUCCUGUGGCACUC | 427 | 7680 | GAGUGCCACAGGAUGUUUU | 854 |

VEGFR2/KDR NM_002253.1

| | | | | | | | | |
|---|---|---|---|---|---|---|---|---|
| 1 | ACUGAGUCCCGGGACCCCG | 855 | 1 | ACUGAGUCCCGGGACCCCG | 855 | 19 | CGGGGUCCCGGGACUCAGU | 1179 |
| 19 | GGGAGAGCGGUCAGUGUGU | 856 | 19 | GGGAGAGCGGUCAGUGUGU | 856 | 37 | ACACACUGACCGCUCUCCC | 1180 |
| 37 | UGGUCGCUGCGUUUCCUCU | 857 | 37 | UGGUCGCUGCGUUUCCUCU | 857 | 55 | AGAGGAAACGCAGCGACCA | 1181 |
| 55 | UGCCUGCGCCGGGCAUCAC | 858 | 55 | UGCCUGCGCCGGGCAUCAC | 858 | 73 | GUGAUGCCCGGCGCAGGCA | 1182 |
| 73 | CUUGCGCGCCGCAGAAAGU | 859 | 73 | CUUGCGCGCCGCAGAAAGU | 859 | 91 | ACUUUCUGCGGCGCGCAAG | 1183 |
| 91 | UCCGUCUGGCAGCCUGGAU | 860 | 91 | UCCGUCUGGCAGCCUGGAU | 860 | 109 | AUCCAGGCUGCCAGACGGA | 1184 |
| 109 | UAUCCUCUCCUACCGGCAU | 861 | 109 | UAUCCUCUCCUACCGGCAU | 861 | 127 | GUGCCGGUAGGAGGAGGAUA | 1185 |
| 127 | CCCGCAGACGCCCCUGCAG | 862 | 127 | CCCGCAGACGCCCCUGCAG | 862 | 145 | CUGCAGGGGCGUCUGCGGG | 1186 |
| 145 | GCCGCCGGUCGGCGCCCGG | 863 | 145 | GCCGCCGGUCGGCGCCCGG | 863 | 163 | CCGGGCGCCGACCGGCGGC | 1187 |
| 163 | GGCUCCCUAGCCCUGUGCG | 864 | 163 | GGCUCCCUAGCCCUGUGCG | 864 | 181 | CGCACAGGGCUAGGGAGCC | 1188 |
| 181 | GCUCAACUGUCCUGCGCUG | 865 | 181 | GCUCAACUGUCCUGCGCUG | 865 | 199 | CAGCGCAGGACAGUUGAGC | 1189 |
| 199 | GCGGGGUGCCGCGAGUUCC | 866 | 199 | GCGGGGUGCCGCGAGUUCC | 866 | 217 | GGAACUCGCGGCACCCCGC | 1190 |

TABLE II-continued

VEGF and/or VEGFR siNA AND TARGET SEQUENCES

| | | | | | |
|---|---|---|---|---|---|
| 217 CACCUCCGCGCCUCCUUCU | 867 | 217 CACCUCCGCGCCUCCUUCU | 867 | 235 AGAAGGAGGCGCGGAGGUG | 1191 |
| 235 UCUAGACAGGCGCUGGGAG | 868 | 235 UCUAGACAGGCGCUGGGAG | 868 | 253 CUCCCAGCGCCUGUCUAGA | 1192 |
| 253 GAAAGAACCGGCUCCCGAG | 869 | 253 GAAAGAACCGGCUCCCGAG | 869 | 271 CUCGGGAGCCGGUUCUUUC | 1193 |
| 271 GUUCUGGGCAUUUCGCCCG | 870 | 271 GUUCUGGGCAUUUCGCCCG | 870 | 289 CGGGCGAAAUGCCCAGAAC | 1194 |
| 289 GGCUCGAGGUGCAGGAUGC | 871 | 289 GGCUCGAGGUGCAGGAUGC | 871 | 307 GCAUCCUGCACCUCGAGCC | 1195 |
| 307 CAGAGCAAGGUGCUGCUGG | 872 | 307 CAGAGCAAGGUGCUGCUGG | 872 | 325 CCAGCAGCACCUUGCUCAG | 1196 |
| 325 GCCGUCGCCCUGUGGCUCU | 873 | 325 GCCGUCGCCCUGUGGCUCU | 873 | 343 AGAGCCACAGGGCGACGGC | 1197 |
| 343 UGCGUGGAGACCCGGGCCG | 874 | 343 UGCGUGGAGACCCGGGCCG | 874 | 361 CGGCCCGGGUCUCCACGCA | 1198 |
| 361 GCCUCUGUGGGUUUGCCUA | 875 | 361 GCCUCUGUGGGUUUGCCUA | 875 | 379 UAGGCAAACCCACAGAGGC | 1199 |
| 379 AGUGUUUCUCUUGAUCUGC | 876 | 379 AGUGUUUCUCUUGAUCUGC | 876 | 397 GCAGAUCAAGAGAAACACU | 1200 |
| 397 CCCAGGCUCAGCAUACAAA | 877 | 397 CCCAGGCUCAGCAUACAAA | 877 | 415 UUUGUAUGCUGAGCCUGGG | 1201 |
| 415 AAAGACAUACUUACAAUUA | 878 | 415 AAAGACAUACUUACAAUUA | 878 | 433 UAAUUGUAAGUAUGUCUUU | 1202 |
| 433 AAGGCUAAUACAACUCUUC | 879 | 433 AAGGCUAAUACAACUCUUC | 879 | 451 GAAGAGUUGUAUUAGCCUU | 1203 |
| 451 CAAAUUACUUGCAGGGGAC | 880 | 451 CAAAUUACUUGCAGGGGAC | 880 | 469 GUCCCCUGCAAGUAAUUUG | 1204 |
| 469 CAGAGGGACUUGGACUGGC | 881 | 469 CAGAGGGACUUGGACUGGC | 881 | 487 GCCAGUCCAAGUCCCUCUG | 1205 |
| 487 CUUUGGCCCAAUAAUCAGA | 882 | 487 CUUUGGCCCAAUAAUCAGA | 882 | 505 UCUGAUUAUUGGGCCAAAG | 1206 |
| 505 AGUGGCAGUGAGCAAAGGG | 883 | 505 AGUGGCAGUGAGCAAAGGG | 883 | 523 CCCUUUGCUCACUGCCACU | 1207 |
| 523 GUGGAGGUGACUGAGUGGA | 884 | 523 GUGGAGGUGACUGAGUGGA | 884 | 541 UGCACUCAGUCACCUCCAC | 1208 |
| 541 AGCGAUGGCCUCUUCUGUA | 885 | 541 AGCGAUGGCCUCUUCUGUA | 885 | 559 UACAGAAGAGGCCAUCGCU | 1209 |
| 559 AAGCACUCACAAUUCCAA | 886 | 559 AAGCACUCACAAUUCCAA | 886 | 577 UUGGAAUUGUGAGUGUCUU | 1210 |
| 577 AAAGUGAUCGGAAAUGACA | 887 | 577 AAAGUGAUCGGAAAUGACA | 887 | 595 UGUCAUUUCCGAUCACUUU | 1211 |
| 595 ACUGGAGCCUACAAGUGCU | 888 | 595 ACUGGAGCCUACAAGUGCU | 888 | 613 AGCACUUGUAGGCUCCAGU | 1212 |
| 613 UUCUACCGGGAAACUGACU | 889 | 613 UUCUACCGGGAAACUGACU | 889 | 631 AGUCAGUUUCCCGGUAGAA | 1213 |
| 631 UUGGCCUCGGUCAUUUAUG | 890 | 631 UUGGCCUCGGUCAUUUAUG | 890 | 649 CAUAAAUGACCGAGGCCAA | 1214 |
| 649 GUCUAUGUUCAAGAUUACA | 891 | 649 GUCUAUGUUCAAGAUUACA | 891 | 667 UGUAAUCUUGAACAUAGAC | 1215 |
| 667 AGAUCUCCAUUUAUUGCUU | 892 | 667 AGAUCUCCAUUUAUUGCUU | 892 | 685 AAGCAAUAAAUGGAGAUCU | 1216 |
| 685 UCUGUUAGUGACCAACAUG | 893 | 685 UCUGUUAGUGACCAACAUG | 893 | 703 CAUGUUGGUCACUAACAGA | 1217 |
| 703 GGAGUCGUGUACAUUACUG | 894 | 703 GGAGUCGUGUACAUUACUG | 894 | 721 CAGUAAUGUACACGACUCC | 1218 |
| 721 GAGAACAAAAACAAAACUG | 895 | 721 GAGAACAAAAACAAAACUG | 895 | 739 CAGUUUUGUUUUUGUUCUC | 1219 |
| 739 GUGGUGAUUCCAUGUCUCG | 896 | 739 GUGGUGAUUCCAUGUCUCG | 896 | 757 CGAGACAUGGAAUCACCAC | 1220 |
| 757 GGGUCCAUUUCAAAUCUCA | 897 | 757 GGGUCCAUUUCAAAUCUCA | 897 | 775 UGAGAUUUGAAAUGGACCC | 1221 |
| 775 AACGUGUCACUUUGUGCAA | 898 | 775 AACGUGUCACUUUGUGCAA | 898 | 793 UUGCACAAAGUGACACGUU | 1222 |
| 793 AGAUACCCAGAAAAGAGAU | 899 | 793 AGAUACCCAGAAAAGAGAU | 899 | 811 AUCUCUUUUCUGGGUAUCU | 1223 |
| 811 UUUGUUCCUGAUGGUAACA | 900 | 811 UUUGUUCCUGAUGGUAACA | 900 | 829 UGUUACCAUCAGGAACAAA | 1224 |
| 829 AGAAUUUCCUGGGACAGCA | 901 | 829 AGAAUUUCCUGGGACAGCA | 901 | 847 UGCUGUCCCAGGAAAUUCU | 1225 |
| 847 AAGAAGGGCUUUACUAUUC | 902 | 847 AAGAAGGGCUUUACUAUUC | 902 | 865 GAAUAGUAAAGCCCUUCUU | 1226 |
| 865 CCCAGCUACAUGAUCAGCU | 903 | 865 CCCAGCUACAUGAUCAGCU | 903 | 883 AGCUGAUCAUGUAGCUGGG | 1227 |
| 883 UAUGCUGGCAUGGUCUUCU | 904 | 883 UAUGCUGGCAUGGUCUUCU | 904 | 901 AGAAGACCAUGCCAGCAUA | 1228 |
| 901 UGUGAAGCAAAAAUUAAUG | 905 | 901 UGUGAAGCAAAAAUUAAUG | 905 | 919 CAUUAAUUUUUGCUUCACA | 1229 |
| 919 GAUGAAAGUUACCAGUCUA | 906 | 919 GAUGAAAGUUACCAGUCUA | 906 | 937 UAGACUGGUAACUUUCAUC | 1230 |
| 937 AUUAUGUACAUAGUUGUCG | 907 | 937 AUUAUGUACAUAGUUGUCG | 907 | 955 CGACAACUAUGUACAUAAU | 1231 |
| 955 GUUGUAGGGUAUAGGAUUU | 908 | 955 GUUGUAGGGUAUAGGAUUU | 908 | 973 AAAUCCUAUACCCUACAAC | 1232 |
| 973 UAUGAUGUGGUUCUGAGUC | 909 | 973 UAUGAUGUGGUUCUGAGUC | 909 | 991 GACUCAGAACCACAUCAUA | 1233 |
| 991 CCGUCUCAUGGAAUUGAAC | 910 | 991 CCGUCUCAUGGAAUUGAAC | 910 | 1009 GUUCAAUUCCAUGAGACGG | 1234 |
| 1009 CUAUCUGUUGGAGAAAAGC | 911 | 1009 CUAUCUGUUGGAGAAAAGC | 911 | 1027 GCUUUUCUCCAACAGAUAG | 1235 |
| 1027 CUUGUCUUAAAUUGUACAG | 912 | 1027 CUUGUCUUAAAUUGUACAG | 912 | 1045 CUGUACAAUUUAAGACAAG | 1236 |
| 1045 GCAAGAACUGAACUAAAUG | 913 | 1045 GCAAGAACUGAACUAAAUG | 913 | 1063 CAUUUAGUUCAGUUCUUGC | 1237 |
| 1063 GUGGGGAUUGACUUCAACU | 914 | 1063 GUGGGGAUUGACUUCAACU | 914 | 1081 AGUUGAAGUCAAUCCCCAC | 1238 |
| 1081 UGGGAAUACCCUUCUUCGA | 915 | 1081 UGGGAAUACCCUUCUUCGA | 915 | 1099 UCGAAGAAGGGUAUUCCCA | 1239 |
| 1099 AAGCAUCAGCAUAAGAAAC | 916 | 1099 AAGCAUCAGCAUAAGAAAC | 916 | 1117 GUUUCUUAUGCUGAUGCUU | 1240 |
| 1117 CUUGUAAACCGAGACCUAA | 917 | 1117 CUUGUAAACCGAGACCUAA | 917 | 1135 UUAGGUCUCGGUUUACAAG | 1241 |
| 1135 AAAACCCAGUCUGGGGAGUG | 918 | 1135 AAAACCCAGUCUGGGGAGUG | 918 | 1153 CACUCCCAGACUGGGUUUU | 1242 |
| 1153 GAGAUGAAGAAAUUUUUGA | 919 | 1153 GAGAUGAAGAAAUUUUUGA | 919 | 1171 UCAAAAAUUUCUUCAUCUC | 1243 |
| 1171 AGCACCUUAACUAUAGAUG | 920 | 1171 AGCACCUUAACUAUAGAUG | 920 | 1189 CAUCUAUAGUUAAGGUGCU | 1244 |
| 1189 GGUGUAACCCGGAGUGACC | 921 | 1189 GGUGUAACCCGGAGUGACC | 921 | 1207 GGUCACUCCGGGUUACACC | 1245 |
| 1207 CAAGGAUUGUACACCUGUU | 922 | 1207 CAAGGAUUGUACACCUGUU | 922 | 1225 CACAGGUGUACAAUCCUUG | 1246 |
| 1225 GCAGCAUCCAGUGGGCUGA | 923 | 1225 GCAGCAUCCAGUGGGCUGA | 923 | 1243 UCAGCCCACUGGAUGCUGC | 1247 |
| 1243 AUGACCAAGAAGAACAGCA | 924 | 1243 AUGACCAAGAAGAACAGCA | 924 | 1261 UGCUGUUCUUCUUGGUCAU | 1248 |
| 1261 ACAUUUGUCAGGUCCAUG | 925 | 1261 ACAUUUGUCAGGUCCAUG | 925 | 1279 CAUGGACCCUGACAAAUGU | 1249 |
| 1279 GAAAAACCUUUUGUUUGCUU | 926 | 1279 GAAAAACCUUUUGUUUGCUU | 926 | 1297 AAGCAACAAAAGGUUUUUC | 1250 |
| 1297 UUUGGAAGUGGCAUGGAAU | 927 | 1297 UUUGGAAGUGGCAUGGAAU | 927 | 1315 AUUCCAUGCCACUUCCAAA | 1251 |
| 1315 UCUCUGGUGGAAGCCACGG | 928 | 1315 UCUCUGGUGGAAGCCACGG | 928 | 1333 CCGUGGCUUCCACCAGAGA | 1252 |
| 1333 GUGGGGGAGCGUGUCAGAA | 929 | 1333 GUGGGGGAGCGUGUCAGAA | 929 | 1351 UUCUGACACGCUCCCCCAC | 1253 |
| 1351 AUCCCUGCGAAGUACCUUG | 930 | 1351 AUCCCUGCGAAGUACCUUG | 930 | 1369 CAAGGUACUUCGCAGGGAU | 1254 |
| 1369 GGUUACCCACCCCCAGAAA | 931 | 1369 GGUUACCCACCCCCAGAAA | 931 | 1387 UUUCUGGGGUGGGUAACC | 1255 |
| 1387 AUAAAAUGGUAUAAAAAUG | 932 | 1387 AUAAAAUGGUAUAAAAAUG | 932 | 1405 CAUUUUUAUACCAUUUUAU | 1256 |
| 1405 GGAAUACCCUUGAGUCCA | 933 | 1405 GGAAUACCCUUGAGUCCA | 933 | 1423 UGGACUCAAGGGUAUUCC | 1257 |
| 1423 AAUCACACAAUUAAAGCGG | 934 | 1423 AAUCACACAAUUAAAGCGG | 934 | 1441 CCGCUUUAAUUGUGUGAUU | 1258 |
| 1441 GGGCAUGUACUGACGAUUA | 935 | 1441 GGGCAUGUACUGACGAUUA | 935 | 1459 UAAUCGUCAGUACAUGCCC | 1259 |
| 1459 AUGGAAGUGAGUGAAAGAG | 936 | 1459 AUGGAAGUGAGUGAAAGAG | 936 | 1477 CUCUUUCACUCACUUCCAU | 1260 |
| 1477 GACACAGGAAAUUCACUG | 937 | 1477 GACACAGGAAAUUCACUG | 937 | 1495 CAGUGUAAUUUCCUGUGUC | 1261 |
| 1495 GUCAUCCUUACCAUCCCA | 938 | 1495 GUCAUCCUUACCAUCCCA | 938 | 1513 UGGGAUUGGUAAGGAUGAC | 1262 |
| 1513 AUUUCAAAGGAGAAGCAGA | 939 | 1513 AUUUCAAAGGAGAAGCAGA | 939 | 1531 UCUGCUUCUCCUUUGAAAU | 1263 |
| 1531 AGCCAUGUGGUCUCUCUGG | 940 | 1531 AGCCAUGUGGUCUCUCUGG | 940 | 1549 CCAGAGAGACCACAUGGCU | 1264 |
| 1549 GUUGUGUAUGUCCCACCCC | 941 | 1549 GUUGUGUAUGUCCCACCCC | 941 | 1567 GGGGUGGGACAUACACAAC | 1265 |
| 1567 CAGAUUGGUGAGAAAUCUC | 942 | 1567 CAGAUUGGUGAGAAAUCUC | 942 | 1585 GAGAUUUCUCACCAAUCUG | 1266 |
| 1585 CUAAUCUCCUGUGGAUU | 943 | 1585 CUAAUCUCCUGUGGAUU | 943 | 1603 AAUCCACAGGAGAGAUUAG | 1267 |

TABLE II-continued

VEGF and/or VEGFR siNA AND TARGET SEQUENCES

| | | | | | |
|---|---|---|---|---|---|
| 1603 UCCUACCAGUACGGCACCA | 944 | 1603 UCCUACCAGUACGGCACCA | 944 | 1621 UGGUGCCGUACUGGUAGGA | 1268 |
| 1621 ACUCAAACGCUGACAUGUA | 945 | 1621 ACUCAAACGCUGACAUGUA | 945 | 1639 UACAUGUCAGCGUUUGAGU | 1269 |
| 1639 ACGGUCUAUGCCAUUCCUC | 946 | 1639 ACGGUCUAUGCCAUUCCUC | 946 | 1657 GAGGAAUGGCAUAGACCGU | 1270 |
| 1657 CCCCCGCAUCACAUCCACU | 947 | 1657 CCCCCGCAUCACAUCCACU | 947 | 1675 AGUGGAUGUGAUGCGGGGG | 1271 |
| 1675 UGGUAUUGGCAGUUGGAGG | 948 | 1675 UGGUAUUGGCAGUUGGAGG | 948 | 1693 CCUCCAACUGCCAAUACCA | 1272 |
| 1693 GAAGAGUGCGCCAACGAGC | 949 | 1693 GAAGAGUGCGCCAACGAGC | 949 | 1711 GCUCGUUUGCGCACUCUUC | 1273 |
| 1711 CCCAGCCAAGCUGUCUCAG | 950 | 1711 CCCAGCCAAGCUGUCUCAG | 950 | 1729 CUGAGACAGCUUGGCUGGG | 1274 |
| 1729 GUGACAAACCCAUACCCUU | 951 | 1729 GUGACAAACCCAUACCCUU | 951 | 1747 AAGGGUAUGGGUUUGUCAC | 1275 |
| 1747 UGUGAAGAAUGGAGAAGUG | 952 | 1747 UGUGAAGAAUGGAGAAGUG | 952 | 1765 CACUUCUCCAUUCUUCACA | 1276 |
| 1765 GUGGAGGACUUCCAGGGAG | 953 | 1765 GUGGAGGACUUCCAGGGAG | 953 | 1783 CUCCCUGGAAGUCCUCCAC | 1277 |
| 1783 GGAAAUAAAAUUGAAGUUA | 954 | 1783 GGAAAUAAAAUUGAAGUUA | 954 | 1801 UAACUUCAAUUUUAUUUCC | 1278 |
| 1801 AAUAAAAAUCAAUUUGCUC | 955 | 1801 AAUAAAAAUCAAUUUGCUC | 955 | 1819 GAGCAAAUUGAUUUUUAUU | 1279 |
| 1819 CUAAUUGAAGGAAAAAACA | 956 | 1819 CUAAUUGAAGGAAAAAACA | 956 | 1837 UGUUUUUUCCUUCAAUUAG | 1280 |
| 1837 AAAACUGUAAGUACCCUUG | 957 | 1837 AAAACUGUAAGUACCCUUG | 957 | 1855 CAAGGGUACUUACAGUUUU | 1281 |
| 1855 GUUAUCCAAGCGGCAAAUG | 958 | 1855 GUUAUCCAAGCGGCAAAUG | 958 | 1873 CAUUUGCCGCUUGGAUAAC | 1282 |
| 1873 GUGUCAGCUUUGUACAAAU | 959 | 1873 GUGUCAGCUUUGUACAAAU | 959 | 1891 AUUUGUACAAAGCUGACAC | 1283 |
| 1891 UGUGAAGCGGUCAACAAAG | 960 | 1891 UGUGAAGCGGUCAACAAAG | 960 | 1909 CUUUGUUGACCGCUUCACA | 1284 |
| 1909 GUCGGGAGAGGAGAGAGGG | 961 | 1909 GUCGGGAGAGGAGAGAGGG | 961 | 1927 CCCUCUCUCCUCUCCCGAC | 1285 |
| 1927 GUGAUCUCCUUCCACGUGA | 962 | 1927 GUGAUCUCCUUCCACGUGA | 962 | 1945 UCACGUGGAAGGAGAUCAC | 1286 |
| 1945 ACCAGGGGUCCUGAAAUUA | 963 | 1945 ACCAGGGGUCCUGAAAUUA | 963 | 1963 UAAUUUCAGGACCCCUGGU | 1287 |
| 1963 ACUUUGCAACCUGACAUGC | 964 | 1963 ACUUUGCAACCUGACAUGC | 964 | 1981 GCAUGUCAGGUUGCAAAGU | 1288 |
| 1981 CAGCCCACUGAGCAGGAGA | 965 | 1981 CAGCCCACUGAGCAGGAGA | 965 | 1999 UCUCCUGCUCAGUGGGCUG | 1289 |
| 1999 AGCGUGUCUUUGUGGUGCA | 966 | 1999 AGCGUGUCUUUGUGGUGCA | 966 | 2017 UGCACCACAAAGACACGCU | 1290 |
| 2017 ACUGCAGACAGAUCUACGU | 967 | 2017 ACUGCAGACAGAUCUACGU | 967 | 2035 ACGUAGAUCUGUCUGCAGU | 1291 |
| 2035 UUUGAGAACCUCACAUGGU | 968 | 2035 UUUGAGAACCUCACAUGGU | 968 | 2053 ACCAUGUGAGGUUCUCAAA | 1292 |
| 2053 UACAAGCUUGGCCCACAGC | 969 | 2053 UACAAGCUUGGCCCACAGC | 969 | 2071 GCUGUGGGCCAAGCUUGUA | 1293 |
| 2071 CCUCUGCCAAUCCAUGUGG | 970 | 2071 CCUCUGCCAAUCCAUGUGG | 970 | 2089 CCACAUGGAUUGGCAGAGG | 1294 |
| 2089 GGAGAGUUGCCCACACCUG | 971 | 2089 GGAGAGUUGCCCACACCUG | 971 | 2107 CAGGUGUGGGCAACUCUCC | 1295 |
| 2107 GUUUGCAAGAACUUGGAUA | 972 | 2107 GUUUGCAAGAACUUGGAUA | 972 | 2125 UAUCCAAGUUCUUGCAAAC | 1296 |
| 2125 ACUCUUUGGAAAUUGAAUG | 973 | 2125 ACUCUUUGGAAAUUGAAUG | 973 | 2143 CAUUCAAUUUCCAAAGAGU | 1297 |
| 2143 GCCACCAUGUUCUCUAAUA | 974 | 2143 GCCACCAUGUUCUCUAAUA | 974 | 2161 UAUUAGAGAACAUGGUGGC | 1298 |
| 2161 AGCACAAAUGACAUUUUGA | 975 | 2161 AGCACAAAUGACAUUUUGA | 975 | 2179 UCAAAAUGUCAUUUGUGCU | 1299 |
| 2179 AUCAUGGAGCUUAAGAAUG | 976 | 2179 AUCAUGGAGCUUAAGAAUG | 976 | 2197 CAUUCUUAAGCUCCAUGAU | 1300 |
| 2197 GCAUCCUUGCAGGACCAAG | 977 | 2197 GCAUCCUUGCAGGACCAAG | 977 | 2215 CUUGGUCCUGCAAGGAUGC | 1301 |
| 2215 GGAGACUAUGUCUGCCUUG | 978 | 2215 GGAGACUAUGUCUGCCUUG | 978 | 2233 CAAGGCAGACAUAGUCUCC | 1302 |
| 2233 GCUCAAGACAGGAAGACCA | 979 | 2233 GCUCAAGACAGGAAGACCA | 979 | 2251 UGGUCUUCCUGUCUUGAGC | 1303 |
| 2251 AAGAAAAGACAUUGCGUGG | 980 | 2251 AAGAAAAGACAUUGCGUGG | 980 | 2269 CCACGCAAUGUCUUUUCUU | 1304 |
| 2269 GUCAGGCAGCUCACAGUCC | 981 | 2269 GUCAGGCAGCUCACAGUCC | 981 | 2287 GGACUGUGAGCUGCCUGAC | 1305 |
| 2287 CUAGAGCGUGUGGCACCCA | 982 | 2287 CUAGAGCGUGUGGCACCCA | 982 | 2305 UGGGUGCCACACGCUCUAG | 1306 |
| 2305 ACGAUCACAGGAAACCUGG | 983 | 2305 ACGAUCACAGGAAACCUGG | 983 | 2323 CCAGGUUUCCUGUGAUCGU | 1307 |
| 2323 GAGAAUCAGACGACAAGUA | 984 | 2323 GAGAAUCAGACGACAAGUA | 984 | 2341 UACUUGUCGUCUGAUUCUC | 1308 |
| 2341 AUUGGGGAAAGCAUCGAAG | 985 | 2341 AUUGGGGAAAGCAUCGAAG | 985 | 2359 CUUCGAUGCUUUCCCCAAU | 1309 |
| 2359 GUCUCACGGCACGUCUUG | 986 | 2359 GUCUCACGGCACGUCUUG | 986 | 2377 CAGAUGCCGUGACAUGAGAC | 1310 |
| 2377 GGGAAUCCCCCUCCACAGA | 987 | 2377 GGGAAUCCCCCUCCACAGA | 987 | 2395 UCUGUGGAGGGGGAUUCCC | 1311 |
| 2395 AUCAUGUGGUUUAAAGAUA | 988 | 2395 AUCAUGUGGUUUAAAGAUA | 988 | 2413 UAUCUUUAAACCACAUGAU | 1312 |
| 2413 AAUGAGACCCUUGUAGAAG | 989 | 2413 AAUGAGACCCUUGUAGAAG | 989 | 2431 CUUCUACAAGGGUCUCAUU | 1313 |
| 2431 GACUCUGACAUUGUAUUGA | 990 | 2431 GACUCUGACAUUGUAUUGA | 990 | 2449 UCAAUACAAUGUCAGAGUC | 1314 |
| 2449 AAGGAUGGGAACCGGAACC | 991 | 2449 AAGGAUGGGAACCGGAACC | 991 | 2467 GGUUCCGGUUCCCAUCCUU | 1315 |
| 2467 CUCACUAUCCGCAGAGUGA | 992 | 2467 CUCACUAUCCGCAGAGUGA | 992 | 2485 UCACUCUGCGGAUAGUGAG | 1316 |
| 2485 AGGAAGGAGGACGAAGGCC | 993 | 2485 AGGAAGGAGGACGAAGGCC | 993 | 2503 GGCCUUCGUCCUCCUUCCU | 1317 |
| 2503 CUCUACACCUGCCAGGCAU | 994 | 2503 CUCUACACCUGCCAGGCAU | 994 | 2521 AUGCCUGGCAGGUGUAGAG | 1318 |
| 2521 UGCAGUGUUCUUGGCUGUG | 995 | 2521 UGCAGUGUUCUUGGCUGUG | 995 | 2539 CACAGCCAAGAACACUGCA | 1319 |
| 2539 GCAAAAGUGGAGGCAUUUU | 996 | 2539 GCAAAAGUGGAGGCAUUUU | 996 | 2557 AAAAUGCCUCCACUUUUGC | 1320 |
| 2557 UUCAUAAUAGAAGGUGCCC | 997 | 2557 UUCAUAAUAGAAGGUGCCC | 997 | 2575 GGGCACCUUCUAUUAUGAA | 1321 |
| 2575 CAGGAAAAGACGAACUUGG | 998 | 2575 CAGGAAAAGACGAACUUGG | 998 | 2593 CCAAGUUCGUCUUUUCCUG | 1322 |
| 2593 GAAAUCAUUAUUCUAGUAG | 999 | 2593 GAAAUCAUUAUUCUAGUAG | 999 | 2611 CUACUAGAAUAAUGAUUUC | 1323 |
| 2611 GGCACGGCGGUGAUUGCCA | 1000 | 2611 GGCACGGCGGUGAUUGCCA | 1000 | 2629 UGGCAAUCACCGCCGUGCC | 1324 |
| 2629 AUGUUCUUCUGGCUACUUC | 1001 | 2629 AUGUUCUUCUGGCUACUUC | 1001 | 2647 GAAGUAGCCAGAAGAACAU | 1325 |
| 2647 CUUGUCAUCAUCCUACGGA | 1002 | 2647 CUUGUCAUCAUCCUACGGA | 1002 | 2665 UCCGUAGGAUGAUGACAAG | 1326 |
| 2665 ACCGUUAAGCGGGCCAAUG | 1003 | 2665 ACCGUUAAGCGGGCCAAUG | 1003 | 2683 CAUUGGCCCGCUUAACGGU | 1327 |
| 2683 GGAGGGGAACUGAAGACAG | 1004 | 2683 GGAGGGGAACUGAAGACAG | 1004 | 2701 CUGUCUUCAGUUCCCCUCC | 1328 |
| 2701 GGCUACUUGUCCAUCGUCA | 1005 | 2701 GGCUACUUGUCCAUCGUCA | 1005 | 2719 UGACGAUGGACAAGUAGCC | 1329 |
| 2719 AUGGAUCCAGAUGAACUCC | 1006 | 2719 AUGGAUCCAGAUGAACUCC | 1006 | 2737 GGAGUUCAUCUGGAUCCAU | 1330 |
| 2737 CCAUUGGAUGAACAUUGUG | 1007 | 2737 CCAUUGGAUGAACAUUGUG | 1007 | 2755 CACAAUGUUCAUCCAAUGG | 1331 |
| 2755 GAACGACUGCCUUAUGAUG | 1008 | 2755 GAACGACUGCCUUAUGAUG | 1008 | 2773 CAUCAUAAGGCAGUCGUUC | 1332 |
| 2773 GCCAGCAAAUGGGAAUUCC | 1009 | 2773 GCCAGCAAAUGGGAAUUCC | 1009 | 2791 GGAAUUCCCAUUUGCUGGC | 1333 |
| 2791 CCCAGAGACCGGCUGAGC | 1010 | 2791 CCCAGAGACCGGCUGAGC | 1010 | 2809 GCUUCAGCCGGUCUCUGGG | 1334 |
| 2809 CUAGGUAAGCCUCUUGGCC | 1011 | 2809 CUAGGUAAGCCUCUUGGCC | 1011 | 2827 GGCCAAGAGGCUUACCUAG | 1335 |
| 2827 CGUGGUGCCUUUGGCCAAG | 1012 | 2827 CGUGGUGCCUUUGGCCAAG | 1012 | 2845 CUUGGCCAAAGGCACCACG | 1336 |
| 2845 GUGAUUGAAGCAGAUGCCU | 1013 | 2845 GUGAUUGAAGCAGAUGCCU | 1013 | 2863 AGGCAUCUGCUUCAAUCAC | 1337 |
| 2863 UUGGAAUUGACAAGACAG | 1014 | 2863 UUGGAAUUGACAAGACAG | 1014 | 2881 CUGUCUUGUCAAUUCCAAA | 1338 |
| 2881 GCAACUGCAGGACAGUG | 1015 | 2881 GCAACUGCAGGACAGUG | 1015 | 2899 CUACUGCCUGCAAGUUGC | 1339 |
| 2899 GCAGUCAAAAUGUUGAAAG | 1016 | 2899 GCAGUCAAAAUGUUGAAAG | 1016 | 2917 CUUUCAACAUUUUGACUGC | 1340 |
| 2917 GAAGGAGCAACACACAGUG | 1017 | 2917 GAAGGAGCAACACACAGUG | 1017 | 2935 CACUGUGUGUUGCUCCUUC | 1341 |
| 2935 GAGCAUCGAGCUCUCAUGU | 1018 | 2935 GAGCAUCGAGCUCUCAUGU | 1018 | 2953 ACAUGAGAGCUCGAUGCUC | 1342 |
| 2953 UCUGAACUCAAGAUCCUCA | 1019 | 2953 UCUGAACUCAAGAUCCUCA | 1019 | 2971 UGAGGAUCUUGAGUUCAGA | 1343 |
| 2971 AUUCAUAUUGGUCACCAUC | 1020 | 2971 AUUCAUAUUGGUCACCAUC | 1020 | 2989 GAUGGUGACCAAUAUGAAU | 1344 |

TABLE II-continued

VEGF and/or VEGFR siNA AND TARGET SEQUENCES

| | | | | | | | | |
|---|---|---|---|---|---|---|---|---|
| 2989 | CUCAAUGUGGUCAACCUUC | 1021 | 2989 | CUCAAUGUGGUCAACCUUC | 1021 | 3007 | GAAGGUUGACCACAUUGAG | 1345 |
| 3007 | CUAGGUGCCUGUACCAAGC | 1022 | 3007 | CUAGGUGCCUGUACCAAGC | 1022 | 3025 | GCUUGGUACAGGCACCUAG | 1346 |
| 3025 | CCAGGAGGGCCACUCAUGG | 1023 | 3025 | CCAGGAGGGCCACUCAUGG | 1023 | 3043 | CCAUGAGUGGCCCUCCUGG | 1347 |
| 3043 | GUGAUUGUGGAAUUCUGCA | 1024 | 3043 | GUGAUUGUGGAAUUCUGCA | 1024 | 3061 | UGCAGAAUUCCACAAUCAC | 1348 |
| 3061 | AAAUUUGGAAACCUGUCCA | 1025 | 3061 | AAAUUUGGAAACCUGUCCA | 1025 | 3079 | UGGACAGGUUUCCAAAUUU | 1349 |
| 3079 | ACUUACCUGAGGAGCAAGA | 1026 | 3079 | ACUUACCUGAGGAGCAAGA | 1026 | 3097 | UCUUGCUCCUCAGGUAAGU | 1350 |
| 3097 | AGAAAUGAAUUUGUCCCCU | 1027 | 3097 | AGAAAUGAAUUUGUCCCCU | 1027 | 3115 | AGGGGACAAAUUCAUUUCU | 1351 |
| 3115 | UACAAGACCAAAGGGGCAC | 1028 | 3115 | UACAAGACCAAAGGGGCAC | 1028 | 3133 | GUGCCCCUUUGGUCUUGUA | 1352 |
| 3133 | CGAUUCCGUCAAGGGAAAG | 1029 | 3133 | CGAUUCCGUCAAGGGAAAG | 1029 | 3151 | CUUUCCCUUGACGGAAUCG | 1353 |
| 3151 | GACUACGUUGGAGCAAUCC | 1030 | 3151 | GACUACGUUGGAGCAAUCC | 1030 | 3169 | GGAUUGCUCCAACGUAGUC | 1354 |
| 3169 | CCUGUGGAUCUGAAACGGC | 1031 | 3169 | CCUGUGGAUCUGAAACGGC | 1031 | 3187 | GCCGUUUCAGAUCCACAGG | 1355 |
| 3187 | CGCUUGGACAGCAUCACCA | 1032 | 3187 | CGCUUGGACAGCAUCACCA | 1032 | 3205 | UGGUGAUGCUGUCCAAGCG | 1356 |
| 3205 | AGUAGCCAGAGCUCAGCCA | 1033 | 3205 | AGUAGCCAGAGCUCAGCCA | 1033 | 3223 | UGGCUGAGCUCUGGCUACU | 1357 |
| 3223 | AGCUCUGGAUUUGUGGAGG | 1034 | 3223 | AGCUCUGGAUUUGUGGAGG | 1034 | 3241 | CCUCCACAAAUCCAGACGU | 1358 |
| 3241 | GAGAAGUCCCUCAGUGAUG | 1035 | 3241 | GAGAAGUCCCUCAGUGAUG | 1035 | 3259 | CAUCACUGAGGGACUUCUC | 1359 |
| 3259 | GUAGAAGAAGAGGAAGCUC | 1036 | 3259 | GUAGAAGAAGAGGAAGCUC | 1036 | 3277 | GAGCUUCCUCUUCUUCUAC | 1360 |
| 3277 | CCUGAAGAUCUGUAUAAGG | 1037 | 3277 | CCUGAAGAUCUGUAUAAGG | 1037 | 3295 | CCUUAUACAGAUCUUCAGG | 1361 |
| 3295 | GACUUCCUGACCUUGGAGC | 1038 | 3295 | GACUUCCUGACCUUGGAGC | 1038 | 3313 | GCUCCAAGGUCAGGAAGUC | 1362 |
| 3313 | CAUCUCAUCUGUUACAGCU | 1039 | 3313 | CAUCUCAUCUGUUACAGCU | 1039 | 3331 | AGCUGUAACAGAUGAGAUG | 1363 |
| 3331 | UUCCAAGUGGCUAAGGGCA | 1040 | 3331 | UUCCAAGUGGCUAAGGGCA | 1040 | 3349 | UGCCCUUAGCCACUUGGAA | 1364 |
| 3349 | AUGGAGUUCUUGGCAUCGC | 1041 | 3349 | AUGGAGUUCUUGGCAUCGC | 1041 | 3367 | GCGAUGCCAAGAACUCCAU | 1365 |
| 3367 | CGAAAGUGUAUCCACAGGG | 1042 | 3367 | CGAAAGUGUAUCCACAGGG | 1042 | 3385 | CCCUGUGGAUACACUUUCG | 1366 |
| 3385 | GACCUGGCGGCACGAAAUA | 1043 | 3385 | GACCUGGCGGCACGAAAUA | 1043 | 3403 | UAUUUCGUGCCGCCAGGUC | 1367 |
| 3403 | AUCCUCUUAUCGGAGAAGA | 1044 | 3403 | AUCCUCUUAUCGGAGAAGA | 1044 | 3421 | UCUUCUCCGAUAAGAGGAU | 1368 |
| 3421 | AACGUGGUUAAAAUCUGUG | 1045 | 3421 | AACGUGGUUAAAAUCUGUG | 1045 | 3439 | CACAGAUUUUAACCACGUU | 1369 |
| 3439 | GACUUUGGCUUGGCCCGGG | 1046 | 3439 | GACUUUGGCUUGGCCCGGG | 1046 | 3457 | CCCGGGCCAAGCCAAAGUC | 1370 |
| 3457 | GAUAUUUAUAAAGAUCCAG | 1047 | 3457 | GAUAUUUAUAAAGAUCCAG | 1047 | 3475 | CUGGAUCUUUAUAAAUAUC | 1371 |
| 3475 | GAUUAUGUCAGAAAAGGAG | 1048 | 3475 | GAUUAUGUCAGAAAAGGAG | 1048 | 3493 | CUCCUUUUCUGACAUAAUC | 1372 |
| 3493 | GAUGCUCGCCUCCCUUUGA | 1049 | 3493 | GAUGCUCGCCUCCCUUUGA | 1049 | 3511 | UCAAAGGGAGGCGAGCAUC | 1373 |
| 3511 | AAAUGGAUGGCCCCAGAAA | 1050 | 3511 | AAAUGGAUGGCCCCAGAAA | 1050 | 3529 | UUUCUGGGGCCAUCCAUUU | 1374 |
| 3529 | ACAAUUUUGACAGAGUGU | 1051 | 3529 | ACAAUUUUGACAGAGUGU | 1051 | 3547 | ACACUCUGUCAAAAAUUGU | 1375 |
| 3547 | UACACAAUCCAGAGUGACG | 1052 | 3547 | UACACAAUCCAGAGUGACG | 1052 | 3565 | CGUCACUCUGGAUUGUGUA | 1376 |
| 3565 | GUCUGGUCUUUUGGUGUUU | 1053 | 3565 | GUCUGGUCUUUUGGUGUUU | 1053 | 3583 | AAACACCAAAAGACCAGAC | 1377 |
| 3583 | UUGCUGUGGGAAAUAUUUU | 1054 | 3583 | UUGCUGUGGGAAAUAUUUU | 1054 | 3601 | AAAAUAUUUCCCACAGCAA | 1378 |
| 3601 | UCCUUAGGUGCUUCUCCAU | 1055 | 3601 | UCCUUAGGUGCUUCUCCAU | 1055 | 3619 | AUGGAGAAGCACCUAAGGA | 1379 |
| 3619 | UAUCCUGGGGUAAAGAUUG | 1056 | 3619 | UAUCCUGGGGUAAAGAUUG | 1056 | 3637 | CAAUCUUUACCCCAGGAUA | 1380 |
| 3637 | GAUGAAGAAUUUUGUAGGC | 1057 | 3637 | GAUGAAGAAUUUUGUAGGC | 1057 | 3655 | GCCUACAAAAUUCUUCAUC | 1381 |
| 3655 | CGAUUGAAAGAAGGAACUA | 1058 | 3655 | CGAUUGAAAGAAGGAACUA | 1058 | 3673 | UAGUUCCUUCUUUCAAUCG | 1382 |
| 3673 | AGAAUGAGGCCCCUGAUU | 1059 | 3673 | AGAAUGAGGCCCCUGAUU | 1059 | 3691 | AAUCAGGGGCCUCAUUCU | 1383 |
| 3691 | UAUACUACACCAGAAAUGU | 1060 | 3691 | UAUACUACACCAGAAAUGU | 1060 | 3709 | ACAUUUCUGGUGUAGUAUA | 1384 |
| 3709 | UACCAGACCAUGCUGGACU | 1061 | 3709 | UACCAGACCAUGCUGGACU | 1061 | 3727 | AGUCCAGCAUGGUCUGGUA | 1385 |
| 3727 | UGCUGGCACGGGGAGCCCA | 1062 | 3727 | UGCUGGCACGGGGAGCCCA | 1062 | 3745 | UGGGCUCCCCGUGCCAGCA | 1386 |
| 3745 | AGUCAGAGACCCACGUUUU | 1063 | 3745 | AGUCAGAGACCCACGUUUU | 1063 | 3763 | AAAACGUGGGUCUCUGACU | 1387 |
| 3763 | UCAGAGUUGGUGGAACAUU | 1064 | 3763 | UCAGAGUUGGUGGAACAUU | 1064 | 3781 | AAUGUUCCACCAACUCUGA | 1388 |
| 3781 | UUGGGAAAUCUCUUGCAAG | 1065 | 3781 | UUGGGAAAUCUCUUGCAAG | 1065 | 3799 | CUUGCAAGAGAUUUCCCAA | 1389 |
| 3799 | GCUAAUGCUCAGCAGGAUG | 1066 | 3799 | GCUAAUGCUCAGCAGGAUG | 1066 | 3817 | CAUCCUGCUGAGCAUUAGC | 1390 |
| 3817 | GGCAAAGACUACAUUGUUC | 1067 | 3817 | GGCAAAGACUACAUUGUUC | 1067 | 3835 | GAACAAUGUAGUCUUUGCC | 1391 |
| 3835 | CUUCCGAUAUCAGAGACUU | 1068 | 3835 | CUUCCGAUAUCAGAGACUU | 1068 | 3853 | AAGUCUCUGAUAUCGGAAG | 1392 |
| 3853 | UUGAGCAUGGAAGAGGAUU | 1069 | 3853 | UUGAGCAUGGAAGAGGAUU | 1069 | 3871 | AAUCCUCUUCCAUGCUCAA | 1393 |
| 3871 | UCUGGACUCUCUCUGCCUA | 1070 | 3871 | UCUGGACUCUCUCUGCCUA | 1070 | 3889 | UAGGCAGAGAGAGUCCAGA | 1394 |
| 3889 | ACCUCACCUGUUUCCUGUA | 1071 | 3889 | ACCUCACCUGUUUCCUGUA | 1071 | 3907 | UACAGGAAACAGGUGAGGU | 1395 |
| 3907 | AUGGAGGAGGAAGUAU | 1072 | 3907 | AUGGAGGAGGAAGUAU | 1072 | 3925 | AUACUUCCUCCUCCAU | 1396 |
| 3925 | UGUGACCCCAAAUUCCAUU | 1073 | 3925 | UGUGACCCCAAAUUCCAUU | 1073 | 3943 | AAUGGAAUUUGGGGUCACA | 1397 |
| 3943 | UAUGACAACACAGCAGGAA | 1074 | 3943 | UAUGACAACACAGCAGGAA | 1074 | 3961 | UUCCUGCUGUGUUGUCAUA | 1398 |
| 3961 | AUCAGUCAGUAUCUGCAGA | 1075 | 3961 | AUCAGUCAGUAUCUGCAGA | 1075 | 3979 | UCUGCAGAUACUGACUGAU | 1399 |
| 3979 | AACAGUAAGCGAAAGAGCC | 1076 | 3979 | AACAGUAAGCGAAAGAGCC | 1076 | 3997 | GGCUCUUUCGCUUACUGUU | 1400 |
| 3997 | CGGCCUGUGAGUGUAAAAA | 1077 | 3997 | CGGCCUGUGAGUGUAAAAA | 1077 | 4015 | UUUUUACACUCACAGGCCG | 1401 |
| 4015 | ACAUUUGAAGAUAUCCGU | 1078 | 4015 | ACAUUUGAAGAUAUCCGU | 1078 | 4033 | ACGGGAUAUCUUCAAAUGU | 1402 |
| 4033 | UUAGAAGAACCAGAAGUAA | 1079 | 4033 | UUAGAAGAACCAGAAGUAA | 1079 | 4051 | UUACUUCUGGUUCUUCUAA | 1403 |
| 4051 | AAAGUAAUCCCAGAUGACA | 1080 | 4051 | AAAGUAAUCCCAGAUGACA | 1080 | 4069 | UGUCAUCUGGGAUUACUUU | 1404 |
| 4069 | AACCAGACGGACAGUGGUA | 1081 | 4069 | AACCAGACGGACAGUGGUA | 1081 | 4087 | UACCACUGUCCGUCUGGUU | 1405 |
| 4087 | AUGGUUCUUGCCUCAGAAG | 1082 | 4087 | AUGGUUCUUGCCUCAGAAG | 1082 | 4105 | CUUCUGAGGCAAGAACCAU | 1406 |
| 4105 | GAGCUGAAAACUUUGGAAG | 1083 | 4105 | GAGCUGAAAACUUUGGAAG | 1083 | 4123 | CUUCCAAAGUUUUCAGCUC | 1407 |
| 4123 | GACAGAACCAAAUUAUCUC | 1084 | 4123 | GACAGAACCAAAUUAUCUC | 1084 | 4141 | GAGAUAAUUUGGUUCUGUC | 1408 |
| 4141 | CCAUCUUUUGGUGGAAUGG | 1085 | 4141 | CCAUCUUUUGGUGGAAUGG | 1085 | 4159 | CCAUUCCACCAAAAGAUGG | 1409 |
| 4159 | GUGCCCAGCAAAAGCAGGG | 1086 | 4159 | GUGCCCAGCAAAAGCAGGG | 1086 | 4177 | CCCUGCUUUUGCUGGGCAC | 1410 |
| 4177 | GAGUCUGUGGCAUCUGAAG | 1087 | 4177 | GAGUCUGUGGCAUCUGAAG | 1087 | 4195 | CUUCAGAUGCCACAGACUC | 1411 |
| 4195 | GGCUCAAACCAGACAAGCG | 1088 | 4195 | GGCUCAAACCAGACAAGCG | 1088 | 4213 | CGCUUGUCUGGUUUGAGCC | 1412 |
| 4213 | GGCUACCAGUCCGGAUAUC | 1089 | 4213 | GGCUACCAGUCCGGAUAUC | 1089 | 4231 | GAUAUCCGGACUGGUAGCC | 1413 |
| 4231 | CACUCCGAUGACACAGACA | 1090 | 4231 | CACUCCGAUGACACAGACA | 1090 | 4249 | UGUCUGUGUCAUCGGAGUG | 1414 |
| 4249 | ACCACCGUGUACUCCAGUG | 1091 | 4249 | ACCACCGUGUACUCCAGUG | 1091 | 4267 | CACUGGAGUACACGGUGGU | 1415 |
| 4267 | GAGGAAGCAGAACUUUUAA | 1092 | 4267 | GAGGAAGCAGAACUUUUAA | 1092 | 4285 | UUAAAAGUUCUGCUUCCUC | 1416 |
| 4285 | AAGCUGAUAGAGAUUGGAG | 1093 | 4285 | AAGCUGAUAGAGAUUGGAG | 1093 | 4303 | CUCCAAUCUCUAUCAGCUU | 1417 |
| 4303 | GUGCAAACCGGUAGCACAG | 1094 | 4303 | GUGCAAACCGGUAGCACAG | 1094 | 4321 | CUGUGCUACCGGUUUGCAC | 1418 |
| 4321 | GCCCAGAUUCUCCAGCCUG | 1095 | 4321 | GCCCAGAUUCUCCAGCCUG | 1095 | 4339 | CAGGCUGGAGAAUCUGGGC | 1419 |
| 4339 | GACUCGGGGACCACACUGA | 1096 | 4339 | GACUCGGGGACCACACUGA | 1096 | 4357 | UCAGUGUGGUCCCCGAGUC | 1420 |
| 4357 | AGCUCUCCUCCUGUUUAAA | 1097 | 4357 | AGCUCUCCUCCUGUUUAAA | 1097 | 4375 | UUUAAACAGGAGGAGAGCU | 1421 |

TABLE II-continued

VEGF and/or VEGFR siNA AND TARGET SEQUENCES

| | | | | | | | | |
|---|---|---|---|---|---|---|---|---|
| 4375 | AAGGAAGCAUCCACACCCC | 1098 | 4375 | AAGGAAGCAUCCACACCCC | 1098 | 4393 | GGGGUGUGGAUGCUUCCUU | 1422 |
| 4393 | CAACUCCCGGACAUCACAU | 1099 | 4393 | CAACUCCCGGACAUCACAU | 1099 | 4411 | AUGUGAUGUCCGGGAGUUG | 1423 |
| 4411 | UGAGAGGUCUGCUCAGAUU | 1100 | 4411 | UGAGAGGUCUGCUCAGAUU | 1100 | 4429 | AAUCUGAGCAGACCUCUCA | 1424 |
| 4429 | UUUGAAGUGUUGUUCUUUC | 1101 | 4429 | UUUGAAGUGUUGUUCUUUC | 1101 | 4447 | GAAAGAACAACACUUCAAA | 1425 |
| 4447 | CCACCAGCAGGAAGUAGCC | 1102 | 4447 | CCACCAGCAGGAAGUAGCC | 1102 | 4465 | GGCUACUUCCUGCUGGUGG | 1426 |
| 4465 | CGCAUUUGAUUUUCAUUUC | 1103 | 4465 | CGCAUUUGAUUUUCAUUUC | 1103 | 4483 | GAAAUGAAAAAUCAAAUGCG | 1427 |
| 4483 | CGACAACAGAAAAAGGACC | 1104 | 4483 | CGACAACAGAAAAAGGACC | 1104 | 4501 | GGUCCUUUUUCUGUUGUCG | 1428 |
| 4501 | CUCGGACUGCAGGGAGCCA | 1105 | 4501 | CUCGGACUGCAGGGAGCCA | 1105 | 4519 | UGGCUCCCUGCAGUCCGAG | 1429 |
| 4519 | AGUCUUCUAGGCAUAUCCU | 1106 | 4519 | AGUCUUCUAGGCAUAUCCU | 1106 | 4537 | AGGAUAUGCCUAGAAGACU | 1430 |
| 4537 | UGGAAGAGGCUUGUGACCC | 1107 | 4537 | UGGAAGAGGCUUGUGACCC | 1107 | 4555 | GGGUCACAAGCCUCUUCCA | 1431 |
| 4555 | CAAGAAUGUGUCUGUGUCU | 1108 | 4555 | CAAGAAUGUGUCUGUGUCU | 1108 | 4573 | AGACACAGACACAUUCUUG | 1432 |
| 4573 | UUCUCCCAGUGUUGACCUG | 1109 | 4573 | UUCUCCCAGUGUUGACCUG | 1109 | 4591 | CAGGUCAACACUGGGAGAA | 1433 |
| 4591 | GAUCCUCUUUUUUCAUUCA | 1110 | 4591 | GAUCCUCUUUUUUCAUUCA | 1110 | 4609 | UGAAUGAAAAAAGAGGAUC | 1434 |
| 4609 | AUUUAAAAAGCAUUAUCAU | 1111 | 4609 | AUUUAAAAAGCAUUAUCAU | 1111 | 4627 | AUGAUAAUGCUUUUUAAAU | 1435 |
| 4627 | UGCCCCUGCUGCGGGUCUC | 1112 | 4627 | UGCCCCUGCUGCGGGUCUC | 1112 | 4645 | GAGACCCGCAGCAGGGGCA | 1436 |
| 4645 | CACCAUGGGUUUAGAACAA | 1113 | 4645 | CACCAUGGGUUUAGAACAA | 1113 | 4663 | UUGUUCUAAACCCAUGGUG | 1437 |
| 4663 | AAGAGCUUCAAGCAAUGGC | 1114 | 4663 | AAGAGCUUCAAGCAAUGGC | 1114 | 4681 | GCCAUUGCUUGAAGCUCUU | 1438 |
| 4681 | CCCCAUCCUCAAAGAAGUA | 1115 | 4681 | CCCCAUCCUCAAAGAAGUA | 1115 | 4699 | UACUUCUUUGAGGAUGGGG | 1439 |
| 4699 | AGCAGUACCUGGGGAGCUG | 1116 | 4699 | AGCAGUACCUGGGGAGCUG | 1116 | 4717 | CAGCUCCCCAGGUACUGCU | 1440 |
| 4717 | GACACUUCUGUAAAACUAG | 1117 | 4717 | GACACUUCUGUAAAACUAG | 1117 | 4735 | CUAGUUUUACAGAAGUGUC | 1441 |
| 4735 | GAAGAUAAACCAGGCAACG | 1118 | 4735 | GAAGAUAAACCAGGCAACG | 1118 | 4753 | CGUUGCCUGGUUUAUCUUC | 1442 |
| 4753 | GUAAGUGUUCGAGGUGUUG | 1119 | 4753 | GUAAGUGUUCGAGGUGUUG | 1119 | 4771 | CAACACCUCGAACACUUAC | 1443 |
| 4771 | GAAGAUGGGAAGGAUUUGC | 1120 | 4771 | GAAGAUGGGAAGGAUUUGC | 1120 | 4789 | GCAAAUCCUUCCCAUCUUC | 1444 |
| 4789 | CAGGGCUGAGUCUAUCCAA | 1121 | 4789 | CAGGGCUGAGUCUAUCCAA | 1121 | 4807 | UUGGAUAGACUCAGCCCUG | 1445 |
| 4807 | AGAGGCUUUGUUUAGGACG | 1122 | 4807 | AGAGGCUUUGUUUAGGACG | 1122 | 4825 | CGUCCUAAACAAAGCCUCU | 1446 |
| 4825 | GUGGGUCCCAAGCCAAGCC | 1123 | 4825 | GUGGGUCCCAAGCCAAGCC | 1123 | 4843 | GGCUUGGCUUGGGACCCAC | 1447 |
| 4843 | CUUAAGUGUGGAAUUCGGA | 1124 | 4843 | CUUAAGUGUGGAAUUCGGA | 1124 | 4861 | UCCGAAUUCCACACUUAAG | 1448 |
| 4861 | AUUGAUAGAAAGGAAGACU | 1125 | 4861 | AUUGAUAGAAAGGAAGACU | 1125 | 4879 | AGUCUUCCUUUCUAUCAAU | 1449 |
| 4879 | UAACGUUACCUUGCUUUGG | 1126 | 4879 | UAACGUUACCUUGCUUUGG | 1126 | 4897 | CCAAAGCAAGGUAACGUUA | 1450 |
| 4897 | GAGAGUACUGGAGCCUGCA | 1127 | 4897 | GAGAGUACUGGAGCCUGCA | 1127 | 4915 | UGCAGGCUCCAGUACUCUC | 1451 |
| 4915 | AAAUGCAUUGUGUUUGCUC | 1128 | 4915 | AAAUGCAUUGUGUUUGCUC | 1128 | 4933 | GAGCAAACACAAUGCAUUU | 1452 |
| 4933 | CUGGUGGAGGUGGGCAUGG | 1129 | 4933 | CUGGUGGAGGUGGGCAUGG | 1129 | 4951 | CCAUGCCCACCUCCACCAG | 1453 |
| 4951 | GGGUCUGUUCUGAAAUGUA | 1130 | 4951 | GGGUCUGUUCUGAAAUGUA | 1130 | 4969 | UACAUUUCAGAACAGACCC | 1454 |
| 4969 | AAAGGGUUCAGACGGGGUU | 1131 | 4969 | AAAGGGUUCAGACGGGGUU | 1131 | 4987 | AACCCCGUCUGAACCCUUU | 1455 |
| 4987 | UUCUGGGUUUUAGAAGGUG | 1132 | 4987 | UUCUGGGUUUUAGAAGGUG | 1132 | 5005 | CAACCUUCUAAAACCAGAA | 1456 |
| 5005 | GCGUGUUCUUCGAGUUGGG | 1133 | 5005 | GCGUGUUCUUCGAGUUGGG | 1133 | 5023 | CCCAACUCGAAGAACACGC | 1457 |
| 5023 | GCUAAAGUAGAGUUCGUUG | 1134 | 5023 | GCUAAAGUAGAGUUCGUUG | 1134 | 5041 | CAACGAACUCUACUUUAGC | 1458 |
| 5041 | GUGCUGUUUCUGACUCCUA | 1135 | 5041 | GUGCUGUUUCUGACUCCUA | 1135 | 5059 | UAGGAGUCAGAAACAGCAC | 1459 |
| 5059 | AAUGAGAGUUCCUUCCAGA | 1136 | 5059 | AAUGAGAGUUCCUUCCAGA | 1136 | 5077 | UCUGGAAGGAACUCUCAUU | 1460 |
| 5077 | ACCGUUAGCUGUCUCCUUG | 1137 | 5077 | ACCGUUAGCUGUCUCCUUG | 1137 | 5095 | CAAGGAGACAGCUAACGGU | 1461 |
| 5095 | GCCAAGCCCCAGGAAGAAA | 1138 | 5095 | GCCAAGCCCCAGGAAGAAA | 1138 | 5113 | UUUCUUCCUGGGGCUUGGC | 1462 |
| 5113 | AAUGAUGCAGCUCUGGCUC | 1139 | 5113 | AAUGAUGCAGCUCUGGCUC | 1139 | 5131 | GAGCCAGAGCUGCAUCAUU | 1463 |
| 5131 | CCUUGUCUCCCAGGCUGAU | 1140 | 5131 | CCUUGUCUCCCAGGCUGAU | 1140 | 5149 | AUCAGCCUGGGAGACAAGG | 1464 |
| 5149 | UCCUUUAUUCAGAAUACCA | 1141 | 5149 | UCCUUUAUUCAGAAUACCA | 1141 | 5167 | UGGUAUUCUGAAUAAAGGA | 1465 |
| 5167 | ACAAAGAAAGGACAUUCAG | 1142 | 5167 | ACAAAGAAAGGACAUUCAG | 1142 | 5185 | CUGAAUGUCCUUUCUUUGU | 1466 |
| 5185 | GCUCAAGGCUCCCUGCCGU | 1143 | 5185 | GCUCAAGGCUCCCUGCCGU | 1143 | 5203 | ACGGCAGGGAGCCUUGAGC | 1467 |
| 5203 | UGUUGAAGAGUUCGACUG | 1144 | 5203 | UGUUGAAGAGUUCGACUG | 1144 | 5221 | CAGUCAGAACUCUUCAACA | 1468 |
| 5221 | GCACAAACCAGCUUCUGGU | 1145 | 5221 | GCACAAACCAGCUUCUGGU | 1145 | 5239 | ACCAGAAGCUGGUUUGUGC | 1469 |
| 5239 | UUUCUUCUGGAAUGAAUAC | 1146 | 5239 | UUUCUUCUGGAAUGAAUAC | 1146 | 5257 | GUAUUCAUUCCAGAAGAAA | 1470 |
| 5257 | CCCUCAUAUCUGUCCUGAU | 1147 | 5257 | CCCUCAUAUCUGUCCUGAU | 1147 | 5275 | AUCAGGACAGAUAUGAGGG | 1471 |
| 5275 | UGUGAUAUGUCUGAGACUG | 1148 | 5275 | UGUGAUAUGUCUGAGACUG | 1148 | 5293 | CAGUCUCAGACAUAUCACA | 1472 |
| 5293 | GAAUGCGGGAGGUUCAAUG | 1149 | 5293 | GAAUGCGGGAGGUUCAAUG | 1149 | 5311 | CAUUGAACCUCCCGCAUUC | 1473 |
| 5311 | GUGAAGCUGUGUGUGGUGU | 1150 | 5311 | GUGAAGCUGUGUGUGGUGU | 1150 | 5329 | ACACCACACACAGCUUCAC | 1474 |
| 5329 | UCAAAGUUUCAGGAAGGAU | 1151 | 5329 | UCAAAGUUUCAGGAAGGAU | 1151 | 5347 | AUCCUUCCUGAAACUUUGA | 1475 |
| 5347 | UUUUACCCUUUUGUUCUUC | 1152 | 5347 | UUUUACCCUUUUGUUCUUC | 1152 | 5365 | GAAGAACAAAAGGGUAAAA | 1476 |
| 5365 | CCCCCUGUCCCCAACCCAC | 1153 | 5365 | CCCCCUGUCCCCAACCCAC | 1153 | 5383 | GUGGGUUGGGGACAGGGGG | 1477 |
| 5383 | CUCUCACCCCGCAACCCAU | 1154 | 5383 | CUCUCACCCCGCAACCCAU | 1154 | 5401 | AUGGGUUGCGGGGUGAGAG | 1478 |
| 5401 | UCAGUAUUUUAGUUAUUUG | 1155 | 5401 | UCAGUAUUUUAGUUAUUUG | 1155 | 5419 | CAAAUAACUAAAAUACUGA | 1479 |
| 5419 | GGCCUCUACUCCAGUAAAC | 1156 | 5419 | GGCCUCUACUCCAGUAAAC | 1156 | 5437 | GUUUACUGGAGUAGAGGCC | 1480 |
| 5437 | CCUGAUUGGGUUUUGUCAC | 1157 | 5437 | CCUGAUUGGGUUUUGUCAC | 1157 | 5455 | GUGACAAAACCCAAUCAGG | 1481 |
| 5455 | CUCUCUGAAUGAUUAUUAG | 1158 | 5455 | CUCUCUGAAUGAUUAUUAG | 1158 | 5473 | CUAAUAAUCAUUCAGAGAG | 1482 |
| 5473 | GCCAGACUUCAAAAUUAUU | 1159 | 5473 | GCCAGACUUCAAAAUUAUU | 1159 | 5491 | AAUAAUUUUGAAGUCUGGC | 1483 |
| 5491 | UUUAUAGCCCAAAUUAUAA | 1160 | 5491 | UUUAUAGCCCAAAUUAUAA | 1160 | 5509 | UUAUAAUUUGGGCUAUAAA | 1484 |
| 5509 | ACAUCUAUUGUAUUAUGUU | 1161 | 5509 | ACAUCUAUUGUAUUAUGUU | 1161 | 5527 | UAAAUAAUACAAUAGAUGU | 1485 |
| 5527 | AGACUUUUAACAUAUAGAG | 1162 | 5527 | AGACUUUUAACAUAUAGAG | 1162 | 5545 | CUCUAUAUGUUAAAAGUCU | 1486 |
| 5545 | GCUAUUCUACUGAUUUUUU | 1163 | 5545 | GCUAUUCUACUGAUUUUUU | 1163 | 5563 | AAAAAUCAGUAGAAUAGC | 1487 |
| 5563 | UGCCCUUGUUCUGUCCUUU | 1164 | 5563 | UGCCCUUGUUCUGUCCUUU | 1164 | 5581 | AAAGGACAGAACAAGGGCA | 1488 |
| 5581 | UUUUUCAAAAAGAAAAAUG | 1165 | 5581 | UUUUUCAAAAAGAAAAAUG | 1165 | 5599 | CAUUUUCUUUUUUGAAAAA | 1489 |
| 5599 | GUGUUUUUUGUUUGGUACC | 1166 | 5599 | GUGUUUUUUGUUUGGUACC | 1166 | 5617 | GGUACCAAACAAAAAACAC | 1490 |
| 5617 | CAUAGUGUGAAAUGCUGGG | 1167 | 5617 | CAUAGUGUGAAAUGCUGGG | 1167 | 5635 | CCCAGCAUUUCACACUAUG | 1491 |
| 5635 | GAACAAUGACUAUAAGACA | 1168 | 5635 | GAACAAUGACUAUAAGACA | 1168 | 5653 | UGUCUUAUAGUCAUUGUUC | 1492 |
| 5653 | AUGCUAUGGCACAUAUAUU | 1169 | 5653 | AUGCUAUGGCACAUAUAUU | 1169 | 5671 | AAUAUAUGUGCCAUAGCAU | 1493 |
| 5671 | UUAUAGUCUGUUUAUGUAG | 1170 | 5671 | UUAUAGUCUGUUUAUGUAG | 1170 | 5689 | CUACAUAAACAGACUAUAA | 1494 |
| 5689 | GAAACAAAUGUAAUAUAUU | 1171 | 5689 | GAAACAAAUGUAAUAUAUU | 1171 | 5707 | AAUAUAUUACAUUUGUUUC | 1495 |
| 5707 | UAAAGCCUUAUAUAUAAUG | 1172 | 5707 | UAAAGCCUUAUAUAUAAUG | 1172 | 5725 | CAUUAUAUAUAAGGCUUUA | 1496 |
| 5725 | GAACUUUGUACUAUUCACA | 1173 | 5725 | GAACUUUGUACUAUUCACA | 1173 | 5743 | UGUGAAUAGUACAAAGUUC | 1497 |
| 5743 | AUUUUGUAUCAGUAUUAUG | 1174 | 5743 | AUUUUGUAUCAGUAUUAUG | 1174 | 5761 | CAUAAUACUGAUACAAAAU | 1498 |

TABLE II-continued

VEGF and/or VEGFR siNA AND TARGET SEQUENCES

| | | | | | |
|---|---|---|---|---|---|
| 5761 GUAGCAUAACAAAGGUCAU | 1175 | 5761 GUAGCAUAACAAAGGUCAU | 1175 | 5779 AUGACCUUUGUUAUGCUAC | 1499 |
| 5779 UAAUGCUUUCAGCAAUUGA | 1176 | 5779 UAAUGCUUUCAGCAAUUGA | 1176 | 5797 UCAAUUGCUGAAAGCAUUA | 1500 |
| 5797 AUGUCAUUUUAUUAAAGAA | 1177 | 5797 AUGUCAUUUUAUUAAAGAA | 1177 | 5815 UUCUUUAAUAAAAUGACAU | 1501 |
| 5812 AGAACAUUGAAAAACUUGA | 1178 | 5812 AGAACAUUGAAAAACUUGA | 1178 | 5830 UCAAGUUUUUCAAUGUUCU | 1502 |

VEGFR3/FLT4 NM_002020.1

| | | | | | |
|---|---|---|---|---|---|
| 1 ACCCACGCGCAGCGGCCGG | 1503 | 1 ACCCACGCGCAGCGGCCGG | 1503 | 19 CCGGCCGCUGCGCGUGGGU | 1750 |
| 19 GAGAUGCAGCGGGGCGCCG | 1504 | 19 GAGAUGCAGCGGGGCGCCG | 1504 | 37 CGGCGCCCCGCUGCAUCUC | 1751 |
| 37 GCGCUGUGCCUGCGACUGU | 1505 | 37 GCGCUGUGCCUGCGACUGU | 1505 | 55 ACAGUCGCAGGCACAGCGC | 1752 |
| 55 UGGCUCUGCCUGGGACUCC | 1506 | 55 UGGCUCUGCCUGGGACUCC | 1506 | 73 GGAGUCCCAGGCAGAGCCA | 1753 |
| 73 CUGGACGGCCUGGUGAGUG | 1507 | 73 CUGGACGGCCUGGUGAGUG | 1507 | 91 CACUCACCAGGCCGUCCAG | 1754 |
| 91 GACUACUCCAUGACCCCCC | 1508 | 91 GACUACUCCAUGACCCCCC | 1508 | 109 GGGGGGUCAUGGAGUAGUC | 1755 |
| 109 CCGACCUUGAACAUCACGG | 1509 | 109 CCGACCUUGAACAUCACGG | 1509 | 127 CCGUGAUGUUCAAGGUCGG | 1756 |
| 127 GAGGAGUCACACGUCAUCG | 1510 | 127 GAGGAGUCACACGUCAUCG | 1510 | 145 CGAUGACGUGUGACUCCUC | 1757 |
| 145 GACACCGGUGACAGCCUGU | 1511 | 145 GACACCGGUGACAGCCUGU | 1511 | 163 ACAGGCUGUCACCGGUGUC | 1758 |
| 163 UCCAUCUCCUGCAGGGGAC | 1512 | 163 UCCAUCUCCUGCAGGGGAC | 1512 | 181 GUCCCCUGCAGGAGAUGGA | 1759 |
| 181 CAGCACCCCCUCGAGUGGG | 1513 | 181 CAGCACCCCCUCGAGUGGG | 1513 | 199 CCCACUCGAGGGGGUGCUG | 1760 |
| 199 GCUUGGCCAGGAGCUCAGG | 1514 | 199 GCUUGGCCAGGAGCUCAGG | 1514 | 217 CCUGAGCUCCUGGCCAAGC | 1761 |
| 217 GAGGCGCCAGCCACCGGAG | 1515 | 217 GAGGCGCCAGCCACCGGAG | 1515 | 235 CUCCGGUGGCUGGCGCCUC | 1762 |
| 235 GACAAGGACAGCGAGGACA | 1516 | 235 GACAAGGACAGCGAGGACA | 1516 | 253 UGUCCUCGCUGUCCUUGUC | 1763 |
| 253 ACGGGGUGGUGCGAGACU | 1517 | 253 ACGGGGUGGUGCGAGACU | 1517 | 271 AGUCUCGCACCACCCCCGU | 1764 |
| 271 UGCGAGGGCACAGACGCCA | 1518 | 271 UGCGAGGGCACAGACGCCA | 1518 | 289 UGGCGUCUGUGCCCUCGCA | 1765 |
| 289 AGGCCCUACUGCAAGGUGU | 1519 | 289 AGGCCCUACUGCAAGGUGU | 1519 | 307 ACACCUUGCAGUAGGGCCU | 1766 |
| 307 UUGCUGCUGCACGAGGUAC | 1520 | 307 UUGCUGCUGCACGAGGUAC | 1520 | 325 GUACCUCGUGCAGCAGCAA | 1767 |
| 325 CAUGCCAACGACACAGGCA | 1521 | 325 CAUGCCAACGACACAGGCA | 1521 | 343 UGCCUGUGUCGUUGGCAUG | 1768 |
| 343 AGCUACGUCUGCUACUACA | 1522 | 343 AGCUACGUCUGCUACUACA | 1522 | 361 UGUAGUAGCAGACGUAGCU | 1769 |
| 361 AAGUACAUCAAGGCACGCA | 1523 | 361 AAGUACAUCAAGGCACGCA | 1523 | 379 UGCGUGCCUUGAUGUACUU | 1770 |
| 379 AUCGAGGGCACCACGGCCG | 1524 | 379 AUCGAGGGCACCACGGCCG | 1524 | 397 CGGCCGUGGUGCCCUCGAU | 1771 |
| 397 GCCAGCUCCUACGUGUUCG | 1525 | 397 GCCAGCUCCUACGUGUUCG | 1525 | 415 CGAACACGUAGGAGCUGGC | 1772 |
| 415 GUGAGAGACUUUGAGCAGC | 1526 | 415 GUGAGAGACUUUGAGCAGC | 1526 | 433 GCUGCUCAAAGUCUCUCAC | 1773 |
| 433 CCAUUCAUCAACAAGCCUG | 1527 | 433 CCAUUCAUCAACAAGCCUG | 1527 | 451 CAGGCUUGUUGAUGAAUGG | 1774 |
| 451 GACACGCUCUUGGUCAACA | 1528 | 451 GACACGCUCUUGGUCAACA | 1528 | 469 UGUUGACCAAGAGCGUGUC | 1775 |
| 469 AGGAAGGACGCCAUGUGGG | 1529 | 469 AGGAAGGACGCCAUGUGGG | 1529 | 487 CCCACAUGGCGUCCUUCCU | 1776 |
| 487 GUGCCCUGUCUGGGUGUCCA | 1530 | 487 GUGCCCUGUCUGGGUGUCCA | 1530 | 505 UGGACACCAGACAGGGCAC | 1777 |
| 505 AUCCCCGGCCUCAAUGUCA | 1531 | 505 AUCCCCGGCCUCAAUGUCA | 1531 | 523 UGACAUUGAGGCCGGGGAU | 1778 |
| 523 ACGCUGCGCUCGCAAAGCU | 1532 | 523 ACGCUGCGCUCGCAAAGCU | 1532 | 541 AGCUUUGCGAGCGCAGCGU | 1779 |
| 541 UCGGUGCUGUGGCCAGACG | 1533 | 541 UCGGUGCUGUGGCCAGACG | 1533 | 559 CGUCUGGCCACAGCACCGA | 1780 |
| 559 GGGCAGGAGGUGGUGUGGG | 1534 | 559 GGGCAGGAGGUGGUGUGGG | 1534 | 577 CCCACACCACCUCCUGCCC | 1781 |
| 577 GAUGACCGGCGGGGCAUGC | 1535 | 577 GAUGACCGGCGGGGCAUGC | 1535 | 595 GCAUGCCCCGCCGGUCAUC | 1782 |
| 595 CUCGUGUCCACGCCACUGC | 1536 | 595 CUCGUGUCCACGCCACUGC | 1536 | 613 GCAGUGGCGUGGACACGAG | 1783 |
| 613 CUGCACGAUGCCCUGUACC | 1537 | 613 CUGCACGAUGCCCUGUACC | 1537 | 631 GGUACAGGGCAUCGUGCAG | 1784 |
| 631 CUGCAGUGCGAGACCACCU | 1538 | 631 CUGCAGUGCGAGACCACCU | 1538 | 649 AGGUGGUCUCGCACUGCAG | 1785 |
| 649 UGGGGAGACCAGGACUUCC | 1539 | 649 UGGGGAGACCAGGACUUCC | 1539 | 667 GGAAGUCCUGGUCUCCCCA | 1786 |
| 667 CUUUCCAACCCCUUCCUGG | 1540 | 667 CUUUCCAACCCCUUCCUGG | 1540 | 685 CCAGGAAGGGGUUGGAAAG | 1787 |
| 685 GUGCACAUCACAGGCAACG | 1541 | 685 GUGCACAUCACAGGCAACG | 1541 | 703 CGUUGCCUGUGAUGUGCAC | 1788 |
| 703 GAGCUCUAUGACAUCCAGC | 1542 | 703 GAGCUCUAUGACAUCCAGC | 1542 | 721 GCUGGAUGUCAUAGAGCUC | 1789 |
| 721 CUGUUGCCCAGGAAGUCGC | 1543 | 721 CUGUUGCCCAGGAAGUCGC | 1543 | 739 GCGACUUCCUGGGCAACAG | 1790 |
| 739 CUGGAGCUGCUGGUAGGGG | 1544 | 739 CUGGAGCUGCUGGUAGGGG | 1544 | 757 CCCCUACCAGCAGCUCCAG | 1791 |
| 757 GAGAAGCUGGUCCUCAACU | 1545 | 757 GAGAAGCUGGUCCUCAACU | 1545 | 775 AGUUGAGGACCAGCUUCUC | 1792 |
| 775 UGCACCGUGUGGGCUGAGU | 1546 | 775 UGCACCGUGUGGGCUGAGU | 1546 | 793 ACUCAGCCCACACGGUGCA | 1793 |
| 793 UUUAACUCAGGUGUCACCU | 1547 | 793 UUUAACUCAGGUGUCACCU | 1547 | 811 AGGUGACACCUGAGUUAAA | 1794 |
| 811 UUUGACUGGGACUACCCAG | 1548 | 811 UUUGACUGGGACUACCCAG | 1548 | 829 CUGGGUAGUCCCAGUCAAA | 1795 |
| 829 GGGAAGCAGGCAGAGCGGG | 1549 | 829 GGGAAGCAGGCAGAGCGGG | 1549 | 847 CCCGCUCUGCCUGCUUCCC | 1796 |
| 847 GGUAAGUGGGUGCCCGAGC | 1550 | 847 GGUAAGUGGGUGCCCGAGC | 1550 | 865 GCUCGGGCACCCACUUACC | 1797 |
| 865 CGACGCUCCCAACAGACCC | 1551 | 865 CGACGCUCCCAACAGACCC | 1551 | 883 GGGUCUGUUGGGAGCGUCG | 1798 |
| 883 CACACAGAACUCUCCAGCA | 1552 | 883 CACACAGAACUCUCCAGCA | 1552 | 901 UGCUGGAGAGUUCUGUGUG | 1799 |
| 901 AUCCUGACCAUCCACAACG | 1553 | 901 AUCCUGACCAUCCACAACG | 1553 | 919 CGUUGUGGAUGGUCAGGAU | 1800 |
| 919 GUCAGCCAGCACGACCUGG | 1554 | 919 GUCAGCCAGCACGACCUGG | 1554 | 937 CCAGGUCGUGCUGGCUGAC | 1801 |
| 937 GGCUCGUAUGUGUGCAAGG | 1555 | 937 GGCUCGUAUGUGUGCAAGG | 1555 | 955 CCUUGCACACAUACGAGCC | 1802 |
| 955 GCCAACAACGGCAUCCAGC | 1556 | 955 GCCAACAACGGCAUCCAGC | 1556 | 973 GCUGGAUGCCGUUGUUGGC | 1803 |
| 973 CGAUUUCGGGAGAGCACCG | 1557 | 973 CGAUUUCGGGAGAGCACCG | 1557 | 991 CGGUGCUCUCCCGAAAUCG | 1804 |
| 991 GAGGUCAUUGUGCAUGAAA | 1558 | 991 GAGGUCAUUGUGCAUGAAA | 1558 | 1009 UUUCAUGCACAAUGACCUC | 1805 |
| 1009 AAUCCCUUCAUCAGCGUCG | 1559 | 1009 AAUCCCUUCAUCAGCGUCG | 1559 | 1027 CGACGCUGAUGAAGGGAUU | 1806 |
| 1027 GAGUGGCUCAAAGGACCCA | 1560 | 1027 GAGUGGCUCAAAGGACCCA | 1560 | 1045 UGGGUCCUUUGAGCCACUC | 1807 |
| 1045 AUCCUGGAGGCCACGGCAG | 1561 | 1045 AUCCUGGAGGCCACGGCAG | 1561 | 1063 CUGCCGUGGCCUCCAGGAU | 1808 |
| 1063 GGAGACGAGCUGGUGAAGC | 1562 | 1063 GGAGACGAGCUGGUGAAGC | 1562 | 1081 GCUUCACCAGCUCGUCUCC | 1809 |
| 1081 CUGCCCGUGAAGCUGGCAG | 1563 | 1081 CUGCCCGUGAAGCUGGCAG | 1563 | 1099 CUGCCAGCUUCACGGGCAG | 1810 |
| 1099 GCGUACCCCCCGCCCGAGU | 1564 | 1099 GCGUACCCCCCGCCCGAGU | 1564 | 1117 ACUCGGGCGGGGGUACGC | 1811 |
| 1117 UUCCAGUGGUACAAGGAUG | 1565 | 1117 UUCCAGUGGUACAAGGAUG | 1565 | 1135 CAUCCUUGUACCACUGGAA | 1812 |
| 1135 GGAAAGGCACUGUCCGGGC | 1566 | 1135 GGAAAGGCACUGUCCGGGC | 1566 | 1153 GCCCGGACAGUGCCUUUCC | 1813 |
| 1153 CGCCACAGUCCACAUGGCC | 1567 | 1153 CGCCACAGUCCACAUGGCC | 1567 | 1171 GGGCAUGUGGACUGUGGCG | 1814 |
| 1171 CUGGUGCUCAAGGAGGUGA | 1568 | 1171 CUGGUGCUCAAGGAGGUGA | 1568 | 1189 UCACCUCCUUGAGCACCAG | 1815 |
| 1189 ACAGAGGCCAGCACAGGCA | 1569 | 1189 ACAGAGGCCAGCACAGGCA | 1569 | 1207 UGCCUGUGCUGGCCUCUGU | 1816 |
| 1207 ACCUACACCUCGCCCGU | 1570 | 1207 ACCUACACCUCGCCCGU | 1570 | 1225 ACAGGGCGAGGGUGUAGGU | 1817 |
| 1225 UGGAACUCCGCUGCUGGCC | 1571 | 1225 UGGAACUCCGCUGCUGGCC | 1571 | 1243 GGCCAGCAGCGGAGUUCCA | 1818 |
| 1243 CUGAGGCGCAACAUCAGCC | 1572 | 1243 CUGAGGCGCAACAUCAGCC | 1572 | 1261 GGCUGAUGUUGCGCCUCAG | 1819 |

TABLE II-continued

| VEGF and/or VEGFR siNA AND TARGET SEQUENCES ||||||
|---|---|---|---|---|---|
| 1261 CUGGAGCUGGUGGUGAAUG | 1573 | 1261 CUGGAGCUGGUGGUGAAUG | 1573 | 1279 CAUUCACCACCAGCUCCAG | 1820 |
| 1279 GUGCCCCCCAGAUACAUG | 1574 | 1279 GUGCCCCCCAGAUACAUG | 1574 | 1297 CAUGUAUCUGGGGGGCAC | 1821 |
| 1297 GAGAAGGAGGCCUCCUCCC | 1575 | 1297 GAGAAGGAGGCCUCCUCCC | 1575 | 1315 GGGAGGAGGCCUCCUUCUC | 1822 |
| 1315 CCCAGCAUCUACUCGCGUC | 1576 | 1315 CCCAGCAUCUACUCGCGUC | 1576 | 1333 GACGCGAGUAGAUGCUGGG | 1823 |
| 1333 CACAGCCGCCAGGCCCUCA | 1577 | 1333 CACAGCCGCCAGGCCCUCA | 1577 | 1351 UGAGGGCCUGGCGGCUGUG | 1824 |
| 1351 ACCUGCACGGCCUACGGGG | 1578 | 1351 ACCUGCACGGCCUACGGGG | 1578 | 1369 CCCCGUAGGCCGUGCAGGU | 1825 |
| 1369 GUGCCCCUGCCUCUCAGCA | 1579 | 1369 GUGCCCCUGCCUCUCAGCA | 1579 | 1387 UGCUGAGAGGCAGGGGCAC | 1826 |
| 1387 AUCCAGUGGCACUGGCGGC | 1580 | 1387 AUCCAGUGGCACUGGCGGC | 1580 | 1405 GCCGCCAGUGCCACUGGAU | 1827 |
| 1405 CCCUGGACACCCUGCAAGA | 1581 | 1405 CCCUGGACACCCUGCAAGA | 1581 | 1423 UCUUGCAGGGUGUCCAGGG | 1828 |
| 1423 AUGUUUGCCCAGCGUAGUC | 1582 | 1423 AUGUUUGCCCAGCGUAGUC | 1582 | 1441 GACUACGCUGGGCAAACAU | 1829 |
| 1441 CUCCGGCGGCGGCAGCAGC | 1583 | 1441 CUCCGGCGGCGGCAGCAGC | 1583 | 1459 GCUGCUGCCGCCGCCGGAG | 1830 |
| 1459 CAAGACCUCAUGCCACAGU | 1584 | 1459 CAAGACCUCAUGCCACAGU | 1584 | 1477 ACUGUGGCAUGAGGUCUUG | 1831 |
| 1477 UGCCGUGACUGGAGGGCGG | 1585 | 1477 UGCCGUGACUGGAGGGCGG | 1585 | 1495 CCGCCCUCCAGUCACGGCA | 1832 |
| 1495 GUGACCACGCAGGAUGCCG | 1586 | 1495 GUGACCACGCAGGAUGCCG | 1586 | 1513 CGGCAUCCUGCGUGGUCAC | 1833 |
| 1513 GUGAACCCCAUCGAGAGCC | 1587 | 1513 GUGAACCCCAUCGAGAGCC | 1587 | 1531 GGCUCUCGAUGGGGUUCAC | 1834 |
| 1531 CUGGACACCUGGACCGAGU | 1588 | 1531 CUGGACACCUGGACCGAGU | 1588 | 1549 ACUCGGUCCAGGUGUCCAG | 1835 |
| 1549 UUUGUGGAGGGAAAGAAUA | 1589 | 1549 UUUGUGGAGGGAAAGAAUA | 1589 | 1567 UAUUCUUUCCCUCCACAAA | 1836 |
| 1567 AAGACUGUGAGCAAGCUGG | 1590 | 1567 AAGACUGUGAGCAAGCUGG | 1590 | 1585 CCAGCUUGCUCACAGUCUU | 1837 |
| 1585 GUGAUCCAGAAUGCCAACG | 1591 | 1585 GUGAUCCAGAAUGCCAACG | 1591 | 1603 CGUUGGCAUUCUGGAUCAC | 1838 |
| 1603 GUGUCUGCCAUGUACAAGG | 1592 | 1603 GUGUCUGCCAUGUACAAGG | 1592 | 1621 ACUUGUACAUGGCAGACAC | 1839 |
| 1621 UGUGUGGUCUCCAACAAGG | 1593 | 1621 UGUGUGGUCUCCAACAAGG | 1593 | 1639 CCUUGUUGGAGACCACACA | 1840 |
| 1639 GUGGGCCAGGAUGAGCGGC | 1594 | 1639 GUGGGCCAGGAUGAGCGGC | 1594 | 1657 GCCGCUCAUCCUGGCCCAC | 1841 |
| 1657 CUCAUCUACUUCUAUGUGA | 1595 | 1657 CUCAUCUACUUCUAUGUGA | 1595 | 1675 UCACAUAGAAGUAGAUGAG | 1842 |
| 1675 ACCACCAUCCCCGACGGCU | 1596 | 1675 ACCACCAUCCCCGACGGCU | 1596 | 1693 AGCCGUCGGGGAUGGUGGU | 1843 |
| 1693 UUCACCAUCGAAUCCAAGC | 1597 | 1693 UUCACCAUCGAAUCCAAGC | 1597 | 1711 GCUUGGAUUCGAUGGUGAA | 1844 |
| 1711 CCAUCCGAGGAGCUACUAG | 1598 | 1711 CCAUCCGAGGAGCUACUAG | 1598 | 1729 CUAGUAGCUCCUCGGAUGG | 1845 |
| 1729 GAGGGCCAGCCGGUGCUCC | 1599 | 1729 GAGGGCCAGCCGGUGCUCC | 1599 | 1747 GGAGCACCGGCUGGCCCUC | 1846 |
| 1747 CUGAGCUGCCAAGCCGACA | 1600 | 1747 CUGAGCUGCCAAGCCGACA | 1600 | 1765 UGUCGGCUUGGCAGCUCAG | 1847 |
| 1765 AGCUACAAGUACGAGCAUC | 1601 | 1765 AGCUACAAGUACGAGCAUC | 1601 | 1783 GAUGCUCGUACUUGUAGCU | 1848 |
| 1783 CUGCGCUGGUACCGCCUCA | 1602 | 1783 CUGCGCUGGUACCGCCUCA | 1602 | 1801 UGAGGCGGUACCAGCGCAG | 1849 |
| 1801 AACCUGUCCACGCUGCACG | 1603 | 1801 AACCUGUCCACGCUGCACG | 1603 | 1819 CGUGCAGCGUGGACAGGUU | 1850 |
| 1819 GAUGCGCACGGGAACCCGC | 1604 | 1819 GAUGCGCACGGGAACCCGC | 1604 | 1837 GCGGGUUCCCGUGCGCAUC | 1851 |
| 1837 CUUCUGCUCGACUGCAAGA | 1605 | 1837 CUUCUGCUCGACUGCAAGA | 1605 | 1855 UCUUGCAGUCGAGCAGAAG | 1852 |
| 1855 AACGUGCAUCUGUUCGCCA | 1606 | 1855 AACGUGCAUCUGUUCGCCA | 1606 | 1873 UGGCGAACAGAUGCACGUU | 1853 |
| 1873 ACCCCUCUGGCCGCCAGCC | 1607 | 1873 ACCCCUCUGGCCGCCAGCC | 1607 | 1891 GGCUGGCGGCCAGAGGGGU | 1854 |
| 1891 CUGGAGGAGGUGGCACCUG | 1608 | 1891 CUGGAGGAGGUGGCACCUG | 1608 | 1909 CAGGUGCCACCUCCUCCAG | 1855 |
| 1909 GGGGCGCGCCACGCCACGC | 1609 | 1909 GGGGCGCGCCACGCCACGC | 1609 | 1927 GCGUGGCGUGGCGCGCCCC | 1856 |
| 1927 CUCAGCCUGAGUAUCCCCC | 1610 | 1927 CUCAGCCUGAGUAUCCCCC | 1610 | 1945 GGGGGAUACUCAGGCUGAG | 1857 |
| 1945 CGCGUCGCGCCCGAGCACG | 1611 | 1945 CGCGUCGCGCCCGAGCACG | 1611 | 1963 CGUGCUCGGGCGCGACGCG | 1858 |
| 1963 GAGGGCCACUAUGUGUGCG | 1612 | 1963 GAGGGCCACUAUGUGUGCG | 1612 | 1981 CGCACACAUAGUGGCCCUC | 1859 |
| 1981 GAAGUGCAAGACCGGCGCA | 1613 | 1981 GAAGUGCAAGACCGGCGCA | 1613 | 1999 UGCGCCGGUCUUGCACUUC | 1860 |
| 1999 AGCCAUGACAAGCACUGCC | 1614 | 1999 AGCCAUGACAAGCACUGCC | 1614 | 2017 GGCAGUGCUUGUCAUGGCU | 1861 |
| 2017 CACAAGAAGUACCUGUCGG | 1615 | 2017 CACAAGAAGUACCUGUCGG | 1615 | 2035 CCGACAGGUACUUCUUGUG | 1862 |
| 2035 GUGCAGGCCCUGGAAGCCC | 1616 | 2035 GUGCAGGCCCUGGAAGCCC | 1616 | 2053 GGGCUUCCAGGGCCUGCAC | 1863 |
| 2053 CCUCGGCUCACGCAGAACU | 1617 | 2053 CCUCGGCUCACGCAGAACU | 1617 | 2071 AGUUCUGCGUGAGCCGAGG | 1864 |
| 2071 UUGACCGACCUCCUGGUGA | 1618 | 2071 UUGACCGACCUCCUGGUGA | 1618 | 2089 UCACCAGGAGGUCGGUCAA | 1865 |
| 2089 AACGUGAGCGACUCGCUGG | 1619 | 2089 AACGUGAGCGACUCGCUGG | 1619 | 2107 CCAGCGAGUCGCUCACGUU | 1866 |
| 2107 GAGAUGCAGUGCUUGGUGG | 1620 | 2107 GAGAUGCAGUGCUUGGUGG | 1620 | 2125 CCACCAAGCACUGCAUCUC | 1867 |
| 2125 GCCGAGCGCACGCGCCCA | 1621 | 2125 GCCGAGCGCACGCGCCCA | 1621 | 2143 UGGGCGCGUGCGCUCCGGC | 1868 |
| 2143 AGCAUCGUGUGGUACAAAG | 1622 | 2143 AGCAUCGUGUGGUACAAAG | 1622 | 2161 CUUUGUACCACACGAUGCU | 1869 |
| 2161 GACGAGAGGCUGCUGUGAGG | 1623 | 2161 GACGAGAGGCUGCUGUGAGG | 1623 | 2179 CCUCCAGCAGCCUCUCGUC | 1870 |
| 2179 GAAAAGUCUGGAGUCGACU | 1624 | 2179 GAAAAGUCUGGAGUCGACU | 1624 | 2197 AGUCGACUCCAGACUUUUC | 1871 |
| 2197 UUGGCGGACUCCAACCAGA | 1625 | 2197 UUGGCGGACUCCAACCAGA | 1625 | 2215 UCUGGUUGGAGUCCGCCAA | 1872 |
| 2215 AAGCUGAGCAUCCAGCGCG | 1626 | 2215 AAGCUGAGCAUCCAGCGCG | 1626 | 2233 CGCGCUGGAUGCUCAGCUU | 1873 |
| 2233 GUGCGCGAGGAGGAUGCGG | 1627 | 2233 GUGCGCGAGGAGGAUGCGG | 1627 | 2251 CCGCAUCCUCCUCGCGCAC | 1874 |
| 2251 GGACCGUAUCUGUGCAGCG | 1628 | 2251 GGACCGUAUCUGUGCAGCG | 1628 | 2269 CGCUGCACAGAUACGGUCC | 1875 |
| 2269 GUGUGCAGACCCAAGGGCU | 1629 | 2269 GUGUGCAGACCCAAGGGCU | 1629 | 2287 AGCCCUUGGGUCUGCACAC | 1876 |
| 2287 UGCGUCAACUCCUCCGCCA | 1630 | 2287 UGCGUCAACUCCUCCGCCA | 1630 | 2305 UGGCGGAGGAGUUGACGCA | 1877 |
| 2305 AGCGUGGCCGUGGAAGGCU | 1631 | 2305 AGCGUGGCCGUGGAAGGCU | 1631 | 2323 AGCCUUCCACGGCCACGCU | 1878 |
| 2323 UCCGAGGAUAAGGGCAGCA | 1632 | 2323 UCCGAGGAUAAGGGCAGCA | 1632 | 2341 UGCUGCCCUUAUCCUCGGA | 1879 |
| 2341 AUGGAGAUCGUGAUCCUUG | 1633 | 2341 AUGGAGAUCGUGAUCCUUG | 1633 | 2359 CAAGGAUCACGAUCUCCAU | 1880 |
| 2359 GUCGGUACCGGCGUCAUCG | 1634 | 2359 GUCGGUACCGGCGUCAUCG | 1634 | 2377 CGAUGACGCCGGUACCGAC | 1881 |
| 2377 GCUGUCUUCUUCUGGGUCC | 1635 | 2377 GCUGUCUUCUUCUGGGUCC | 1635 | 2395 GGACCCAGAAGAAGACAGC | 1882 |
| 2395 CUCCUCCUCCUCAUCUUCU | 1636 | 2395 CUCCUCCUCCUCAUCUUCU | 1636 | 2413 AGAAGAUGAGGAGGAGGAG | 1883 |
| 2413 UGUAACAUGAGGAGGCCGG | 1637 | 2413 UGUAACAUGAGGAGGCCGG | 1637 | 2431 CCGGCCUCCUCAUGUUACA | 1884 |
| 2431 GCCCACGCAGACAUCAAGA | 1638 | 2431 GCCCACGCAGACAUCAAGA | 1638 | 2449 UCUUGAUGUCUGCGUGGGC | 1885 |
| 2449 ACGGGCUACCUGUCCAUCA | 1639 | 2449 ACGGGCUACCUGUCCAUCA | 1639 | 2467 UGAUGGACAGGUAGCCCGU | 1886 |
| 2467 AUCAUGGACCCCGGGGAGG | 1640 | 2467 AUCAUGGACCCCGGGGAGG | 1640 | 2485 CCUCCCCGGGGUCCAUGAU | 1887 |
| 2485 GUGCCUCUGGAGGAGCAAU | 1641 | 2485 GUGCCUCUGGAGGAGCAAU | 1641 | 2503 AUUGCUCCUCCAGAGGCAC | 1888 |
| 2503 UGCGAAUACCUGUCCUACG | 1642 | 2503 UGCGAAUACCUGUCCUACG | 1642 | 2521 CGUAGGACAGGUAUUCGCA | 1889 |
| 2521 GAUGCCAGCCAGUGGGAAU | 1643 | 2521 GAUGCCAGCCAGUGGGAAU | 1643 | 2539 AUUCCCACUGGCUGGCAUC | 1890 |
| 2539 UUCCCCCGAGAGCGGGAG | 1644 | 2539 UUCCCCCGAGAGCGGGAG | 1644 | 2557 GCAGCCGCUCUCGGGGGAA | 1891 |
| 2557 CACCUGGGGAGAGUGCUCG | 1645 | 2557 CACCUGGGGAGAGUGCUCG | 1645 | 2575 CGAGCACUCUCCCCAGGUG | 1892 |
| 2575 GGCUACGGCGCCUUCGGGA | 1646 | 2575 GGCUACGGCGCCUUCGGGA | 1646 | 2593 UCCCGAAGGCGCCGUAGCC | 1893 |
| 2593 AAGGUGGUGGAAGCCUCCG | 1647 | 2593 AAGGUGGUGGAAGCCUCCG | 1647 | 2611 CGGAGGCUUCCACCACCUU | 1894 |
| 2611 GCUUUCGGCAUCCACAAGG | 1648 | 2611 GCUUUCGGCAUCCACAAGG | 1648 | 2629 CCUUGUGGAUGCCGAAAGC | 1895 |
| 2629 GGCAGCAGCUGUGACACCG | 1649 | 2629 GGCAGCAGCUGUGACACCG | 1649 | 2647 CGGUGUCACAGCUGCUGCC | 1896 |

TABLE II-continued

VEGF and/or VEGFR siNA AND TARGET SEQUENCES

| | | | | | |
|---|---|---|---|---|---|
| 2647 GUGGCCGUGAAAAUGCUGA | 1650 | 2647 GUGGCCGUGAAAAUGCUGA | 1650 | 2665 UCAGCAUUUUCACGGCCAC | 1897 |
| 2665 AAAGAGGGCGCCACGGCCA | 1651 | 2665 AAAGAGGGCGCCACGGCCA | 1651 | 2683 UGGCCGUGGCGCCCUCUUU | 1898 |
| 2683 AGCGAGCAGCGCGCUGA | 1652 | 2683 AGCGAGCAGCGCGCUGA | 1652 | 2701 UCAGCGCGCGCUGCUCGCU | 1899 |
| 2701 AUGUCGGAGCUCAAGAUCC | 1653 | 2701 AUGUCGGAGCUCAAGAUCC | 1653 | 2719 GGAUCUUGAGCUCCGACAU | 1900 |
| 2719 CUCAUUCACAUCGGCAACC | 1654 | 2719 CUCAUUCACAUCGGCAACC | 1654 | 2737 GGUUGCCGAUGUGAAUGAG | 1901 |
| 2737 CACCUCAACGUGGUCACC | 1655 | 2737 CACCUCAACGUGGUCACC | 1655 | 2755 GGUUGACCACGUUGAGGUG | 1902 |
| 2755 CUCCUCGGGGCGUGCACCA | 1656 | 2755 CUCCUCGGGGCGUGCACCA | 1656 | 2773 UGGUGCACGCCCCGAGGAG | 1903 |
| 2773 AAGCCGCAGGGCCCCCUCA | 1657 | 2773 AAGCCGCAGGGCCCCCUCA | 1657 | 2791 UGAGGGGGCCCUGCGGCUU | 1904 |
| 2791 AUGGUGAUCGUGGAGUUCU | 1658 | 2791 AUGGUGAUCGUGGAGUUCU | 1658 | 2809 AGAACUCCACGAUCACCAU | 1905 |
| 2809 UGCAAGUACGGCAACCUCU | 1659 | 2809 UGCAAGUACGGCAACCUCU | 1659 | 2827 AGAGGUUGCCGUACUUGCA | 1906 |
| 2827 UCCAACUUCCUGCGCGCCA | 1660 | 2827 UCCAACUUCCUGCGCGCCA | 1660 | 2845 UGGCGCGCAGGAAGUUGGA | 1907 |
| 2845 AAGCGGGACGCCUUCAGCC | 1661 | 2845 AAGCGGGACGCCUUCAGCC | 1661 | 2863 GGCUGAAGGCGUCCCGCUU | 1908 |
| 2863 CCCUGCGCGGAGAAGUCUC | 1662 | 2863 CCCUGCGCGGAGAAGUCUC | 1662 | 2881 GAGACUUCUCCGCGCAGGG | 1909 |
| 2881 CCCGAGCAGCGCGGACGCU | 1663 | 2881 CCCGAGCAGCGCGGACGCU | 1663 | 2899 AGCGUCCGCGCUGCUCGGG | 1910 |
| 2899 UUCCGCGCCAUGGUGGAGC | 1664 | 2899 UUCCGCGCCAUGGUGGAGC | 1664 | 2917 GCUCCACCAUGGCGCGGAA | 1911 |
| 2917 CUCGCCAGGCUGGAUCGGA | 1665 | 2917 CUCGCCAGGCUGGAUCGGA | 1665 | 2935 UCCGAUCCAGCCUGGCGAG | 1912 |
| 2935 AGGCGGCCGGGGAGCAGCG | 1666 | 2935 AGGCGGCCGGGGAGCAGCG | 1666 | 2953 CGCUGCUCCCCGGCCGCCU | 1913 |
| 2953 GACAGGGUCCUCUUCGCGC | 1667 | 2953 GACAGGGUCCUCUUCGCGC | 1667 | 2971 GCGCGAAGAGGACCCUGUC | 1914 |
| 2971 CGGUUCUCGAAGACCGAGG | 1668 | 2971 CGGUUCUCGAAGACCGAGG | 1668 | 2989 CCUCGGUCUUCGAGAACCG | 1915 |
| 2989 GGCGGAGCGAGGCGGGCUU | 1669 | 2989 GGCGGAGCGAGGCGGGCUU | 1669 | 3007 AAGCCCGCCUCGCUCCGCC | 1916 |
| 3007 UCUCCAGACCAAGAAGCUG | 1670 | 3007 UCUCCAGACCAAGAAGCUG | 1670 | 3025 CAGCUUCUUGGUCUGGAGA | 1917 |
| 3025 GAGGACCUGUGGCUGAGCC | 1671 | 3025 GAGGACCUGUGGCUGAGCC | 1671 | 3043 GGCUCAGCCACAGGUCCUC | 1918 |
| 3043 CCGCUGACCAUGGAAGAUC | 1672 | 3043 CCGCUGACCAUGGAAGAUC | 1672 | 3061 GAUCUUCCAUGGUCAGCGG | 1919 |
| 3061 CUUGUCUGCUACAGCUUCC | 1673 | 3061 CUUGUCUGCUACAGCUUCC | 1673 | 3079 GGAAGCUGUAGCAGACAAG | 1920 |
| 3079 CAGGUGGCCAGAGGGAUGG | 1674 | 3079 CAGGUGGCCAGAGGGAUGG | 1674 | 3097 CCAUCCCUCUGGCCACCUG | 1921 |
| 3097 GAGUUCCUGGCUUCCCGAA | 1675 | 3097 GAGUUCCUGGCUUCCCGAA | 1675 | 3115 UUCGGGAAGCCAGGAACUC | 1922 |
| 3115 AAGUGCAUCCACAGAGACC | 1676 | 3115 AAGUGCAUCCACAGAGACC | 1676 | 3133 GGUCUCUGUGGAUGCACUU | 1923 |
| 3133 CUGGCUGCUCGGAACAUUC | 1677 | 3133 CUGGCUGCUCGGAACAUUC | 1677 | 3151 GAAUGUUCCGAGCAGCCAG | 1924 |
| 3151 CUGCUGUCGGAAAGCGACG | 1678 | 3151 CUGCUGUCGGAAAGCGACG | 1678 | 3169 CGUCGCUUUCCGACAGCAG | 1925 |
| 3169 GUGGUGAAGAUCUGUGACU | 1679 | 3169 GUGGUGAAGAUCUGUGACU | 1679 | 3187 AGUCACAGAUCUUCACCAC | 1926 |
| 3187 UUUGGCCUUGCCCGGGACA | 1680 | 3187 UUUGGCCUUGCCCGGGACA | 1680 | 3205 UGUCCCGGGCAAGGCCAAA | 1927 |
| 3205 AUCUACAAAGACCCCGACU | 1681 | 3205 AUCUACAAAGACCCCGACU | 1681 | 3223 AGUCGGGGUCUUUGUAGAU | 1928 |
| 3223 UACGUCCGCAAGGGCAGUG | 1682 | 3223 UACGUCCGCAAGGGCAGUG | 1682 | 3241 CACUGCCCUUGCGGACGUA | 1929 |
| 3241 GCCCGGCUGCCCCUGAAGU | 1683 | 3241 GCCCGGCUGCCCCUGAAGU | 1683 | 3259 ACUUCAGGGGCAGCCGGGC | 1930 |
| 3259 UGGAUGGCCCCUGAAAGCA | 1684 | 3259 UGGAUGGCCCCUGAAAGCA | 1684 | 3277 UGCUUUCAGGGGCCAUCCA | 1931 |
| 3277 AUCUUCGACAAGGUGUACA | 1685 | 3277 AUCUUCGACAAGGUGUACA | 1685 | 3295 UGUACACCUUGUCGAAGAU | 1932 |
| 3295 ACCACGCAGAGUGACGUGU | 1686 | 3295 ACCACGCAGAGUGACGUGU | 1686 | 3313 ACACGUCACUCUGCGUGGU | 1933 |
| 3313 UGGUCCUUUGGGGUGCUUC | 1687 | 3313 UGGUCCUUUGGGGUGCUUC | 1687 | 3331 GAAGCACCCCAAAGGACCA | 1934 |
| 3331 CUCUGGGAGAUCUUCUCUC | 1688 | 3331 CUCUGGGAGAUCUUCUCUC | 1688 | 3349 GAGAGAAGAUCUCCCAGAG | 1935 |
| 3349 CUGGGGGCCUCCCCGUACC | 1689 | 3349 CUGGGGGCCUCCCCGUACC | 1689 | 3367 GGUACGGGGAGGCCCCCAG | 1936 |
| 3367 CCUGGGGUGCAGAUCAUG | 1690 | 3367 CCUGGGGUGCAGAUCAUG | 1690 | 3385 CAUUGAUCUGCACCCCAGG | 1937 |
| 3385 GAGGAGUUCUGCCAGCGCG | 1691 | 3385 GAGGAGUUCUGCCAGCGCG | 1691 | 3403 CGCGCUGGCAGAACUCCUC | 1938 |
| 3403 GUGAGAGACGGCACAAGGA | 1692 | 3403 GUGAGAGACGGCACAAGGA | 1692 | 3421 UCCUUGUGCCGUCUCUCAC | 1939 |
| 3421 AUGAGGGCCCCGGAGCUGG | 1693 | 3421 AUGAGGGCCCCGGAGCUGG | 1693 | 3439 CCAGCUCCGGGGCCCUCAU | 1940 |
| 3439 GCCACUCCCGCCAUACGCC | 1694 | 3439 GCCACUCCCGCCAUACGCC | 1694 | 3457 GGCGUAUGGCGGGAGUGGC | 1941 |
| 3457 CACAUCAUGCUGAACUGCU | 1695 | 3457 CACAUCAUGCUGAACUGCU | 1695 | 3475 AGCAGUUCAGCAUGAUGUG | 1942 |
| 3475 UGGUCCGGAGACCCCAAGG | 1696 | 3475 UGGUCCGGAGACCCCAAGG | 1696 | 3493 CCUUGGGGUCUCCGGACCA | 1943 |
| 3493 GCGAGACCUGCAUUCUCGG | 1697 | 3493 GCGAGACCUGCAUUCUCGG | 1697 | 3511 CCGAGAAUGCAGGUCUCGC | 1944 |
| 3511 GACCUGGUGGAGAUCCUGG | 1698 | 3511 GACCUGGUGGAGAUCCUGG | 1698 | 3529 CCAGGAUCUCCACCAGGUC | 1945 |
| 3529 GGGGACCUGCUCCAGGGCA | 1699 | 3529 GGGGACCUGCUCCAGGGCA | 1699 | 3547 UGCCCUGGAGCAGGUCCCC | 1946 |
| 3547 AGGGGCCUGCAAGAGGAAG | 1700 | 3547 AGGGGCCUGCAAGAGGAAG | 1700 | 3565 CUUCCUCUUGCAGGCCCCU | 1947 |
| 3565 GAGGAGGUCUGCAUGGCCC | 1701 | 3565 GAGGAGGUCUGCAUGGCCC | 1701 | 3583 GGGCCAUGCAGACCUCCUC | 1948 |
| 3583 CCGCGCAGCUCUCAGAGCU | 1702 | 3583 CCGCGCAGCUCUCAGAGCU | 1702 | 3601 AGCUCUGAGAGCUGCGCGG | 1949 |
| 3601 UCAGAAGAGGGCAGCUUCU | 1703 | 3601 UCAGAAGAGGGCAGCUUCU | 1703 | 3619 AGAAGCUGCCCUCUUCUGA | 1950 |
| 3619 UCGCAGGUGUCCACCAUGG | 1704 | 3619 UCGCAGGUGUCCACCAUGG | 1704 | 3637 CCAUGGUGGACACCUGCGA | 1951 |
| 3637 GCCCUACACAUCGCCCAGG | 1705 | 3637 GCCCUACACAUCGCCCAGG | 1705 | 3655 CCUGGGCGAUGUGUAGGGC | 1952 |
| 3655 GCUGACGCUGAGGACAGCC | 1706 | 3655 GCUGACGCUGAGGACAGCC | 1706 | 3673 GGCUGUCCUCAGCGUCAGC | 1953 |
| 3673 CCGCCAAGCCUGCAGCGCC | 1707 | 3673 CCGCCAAGCCUGCAGCGCC | 1707 | 3691 GGCGCUGCAGGCUUGGCGG | 1954 |
| 3691 CACAGCCUGGCCGCCAGGU | 1708 | 3691 CACAGCCUGGCCGCCAGGU | 1708 | 3709 ACCUGGCGGCCAGGCUGUG | 1955 |
| 3709 UAUUACAACUGGGUGUCCU | 1709 | 3709 UAUUACAACUGGGUGUCCU | 1709 | 3727 AGGACACCCAGUUGUAAUA | 1956 |
| 3727 UUUCCCGGGUGCCUGGCCA | 1710 | 3727 UUUCCCGGGUGCCUGGCCA | 1710 | 3745 UGGCCAGGCACCCGGGAAA | 1957 |
| 3745 AGAGGGGCUAGACCCGUG | 1711 | 3745 AGAGGGGCUAGACCCGUG | 1711 | 3763 CACGGGUCUAGCCCCUCU | 1958 |
| 3763 GGUUCCUCCAGGAUGAAGA | 1712 | 3763 GGUUCCUCCAGGAUGAAGA | 1712 | 3781 UCUUCAUCCUGGAGGAACC | 1959 |
| 3781 ACAUUUGAGGAAUUCCCA | 1713 | 3781 ACAUUUGAGGAAUUCCCA | 1713 | 3799 UGGGGAAUUCCUCAAAUGU | 1960 |
| 3799 AUGACCCCAACGACCUACA | 1714 | 3799 AUGACCCCAACGACCUACA | 1714 | 3817 UGUAGGUCGUUGGGGUCAU | 1961 |
| 3817 AAAGGCUCUGUGGACAACC | 1715 | 3817 AAAGGCUCUGUGGACAACC | 1715 | 3835 GGUUGUCCACAGAGCCUUU | 1962 |
| 3835 CAGACAGACAGUGGGAUGG | 1716 | 3835 CAGACAGACAGUGGGAUGG | 1716 | 3853 CCAUCCCACUGUCUGUCUG | 1963 |
| 3853 GUGCUGGCCUCGGAGGAGU | 1717 | 3853 GUGCUGGCCUCGGAGGAGU | 1717 | 3871 ACUCCUCCGAGGCCAGCAC | 1964 |
| 3871 UUUGAGCAGAUAGAGAGCA | 1718 | 3871 UUUGAGCAGAUAGAGAGCA | 1718 | 3889 UGCUCUCUAUCUGCUCAAA | 1965 |
| 3889 AGGCAUAGACAAGAAAGCG | 1719 | 3889 AGGCAUAGACAAGAAAGCG | 1719 | 3907 CGCUUUCUUGUCUAUGCCU | 1966 |
| 3907 GGCUUCAGGUAGCUGAGC | 1720 | 3907 GGCUUCAGGUAGCUGAGC | 1720 | 3925 GCUUCAGCUACCUGAAGCC | 1967 |
| 3925 CAGAGAGAGAAGGCAGC | 1721 | 3925 CAGAGAGAGAAGGCAGC | 1721 | 3943 GCUGCCUUCUCUCUCUG | 1968 |
| 3943 CAUACGUCAGCAUUUUCUU | 1722 | 3943 CAUACGUCAGCAUUUUCUU | 1722 | 3961 AAGAAAAUGCUGACGUAUG | 1969 |
| 3961 UCUCUGCACUUAUAAGAAA | 1723 | 3961 UCUCUGCACUUAUAAGAAA | 1723 | 3979 UUUCUUAUAAGUGCAGAGA | 1970 |
| 3979 AGAUCAAAGACUUUAAGAC | 1724 | 3979 AGAUCAAAGACUUUAAGAC | 1724 | 3997 GUCUAAAGUCUUUGAUCU | 1971 |
| 3997 CUUUCGCUAUUCUUCUAC | 1725 | 3997 CUUUCGCUAUUCUUCUAC | 1725 | 4015 GUAGAAGAAAUAGCGAAAG | 1972 |
| 4015 CUGCUAUCUACUACAAACU | 1726 | 4015 CUGCUAUCUACUACAAACU | 1726 | 4033 AGUUUGUAGUAGAUAGCAG | 1973 |

TABLE II-continued

VEGF and/or VEGFR siNA AND TARGET SEQUENCES

| | | | | | | |
|---|---|---|---|---|---|---|
| 4033 | UUCAAAGAGGAACCAGGAG | 1727 | 4033 UUCAAAGAGGAACCAGGAG | 1727 | 4051 CUCCUGGUUCCUCUUUGAA | 1974 |
| 4051 | GGACAAGAGGAGCAUGAAA | 1728 | 4051 GGACAAGAGGAGCAUGAAA | 1728 | 4069 UUUCAUGCUCCUCUUGUCC | 1975 |
| 4069 | AGUGGACAAGGAGUGUGAC | 1729 | 4069 AGUGGACAAGGAGUGUGAC | 1729 | 4087 GUCACACUCCUUGUCCACU | 1976 |
| 4087 | CCACUGAAGCACCACAGGG | 1730 | 4087 CCACUGAAGCACCACAGGG | 1730 | 4105 CCCUGUGGUGCUUCAGUGG | 1977 |
| 4105 | GAGGGGUUAGGCCUCCGGA | 1731 | 4105 GAGGGGUUAGGCCUCCGGA | 1731 | 4123 UCCGGAGGCCUAACCCCUC | 1978 |
| 4123 | AUGACUGCGGGCAGGCCUG | 1732 | 4123 AUGACUGCGGGCAGGCCUG | 1732 | 4141 CAGGCCUGCCCGCAGUCAU | 1979 |
| 4141 | GGAUAAUAUCCAGCCUCCC | 1733 | 4141 GGAUAAUAUCCAGCCUCCC | 1733 | 4159 GGGAGGCUGGAUAUUAUCC | 1980 |
| 4159 | CACAAGAAGCUGGUGGAGC | 1734 | 4159 CACAAGAAGCUGGUGGAGC | 1734 | 4177 GCUCCACCAGCUUCUUGUG | 1981 |
| 4177 | CAGAGUGUUCCUGACUCC | 1735 | 4177 CAGAGUGUUCCUGACUCC | 1735 | 4195 GGAGUCAGGGAACACUCUG | 1982 |
| 4195 | CUCCAAGGAAAGGGAGACG | 1736 | 4195 CUCCAAGGAAAGGGAGACG | 1736 | 4213 CGUCUCCCUUUCCUUGGAG | 1983 |
| 4213 | GCCCUUUCAUGGUCUGCUG | 1737 | 4213 GCCCUUUCAUGGUCUGCUG | 1737 | 4231 CAGCAGACCAUGAAAGGGC | 1984 |
| 4231 | GAGUAACAGGUGCCUUCCC | 1738 | 4231 GAGUAACAGGUGCCUUCCC | 1738 | 4249 GGGAAGGCACCUGUUACUC | 1985 |
| 4249 | CAGACACUGGCGUUACUGC | 1739 | 4249 CAGACACUGGCGUUACUGC | 1739 | 4267 GCAGUAACGCCAGUGUCUG | 1986 |
| 4267 | CUUGACCAAAGAGCCCUCA | 1740 | 4267 CUUGACCAAAGAGCCCUCA | 1740 | 4285 UGAGGGCUCUUUGGUCAAG | 1987 |
| 4285 | AAGCGGCCCUUAUGCCAGC | 1741 | 4285 AAGCGGCCCUUAUGCCAGC | 1741 | 4303 GCUGGCAUAAGGGCCGCUU | 1988 |
| 4303 | CGUGACAGAGGGCUCACCU | 1742 | 4303 CGUGACAGAGGGCUCACCU | 1742 | 4321 AGGUGAGCCCUCUGUCACG | 1989 |
| 4321 | UCUUGCCUUCUAGGUCACU | 1743 | 4321 UCUUGCCUUCUAGGUCACU | 1743 | 4339 AGUGACCUAGAAGGCAAGA | 1990 |
| 4339 | UUCUCACAAUGUCCCUUCA | 1744 | 4339 UUCUCACAAUGUCCCUUCA | 1744 | 4357 UGAAGGGACAUUGUGAGAA | 1991 |
| 4357 | AGCACCUGACCCUGUGCCC | 1745 | 4357 AGCACCUGACCCUGUGCCC | 1745 | 4375 GGGCACAGGGUCAGGUGCU | 1992 |
| 4375 | CGCCGAUUAUUCCUUGGUA | 1746 | 4375 CGCCGAUUAUUCCUUGGUA | 1746 | 4393 UACCAAGGAAUAAUCGGCG | 1993 |
| 4393 | AAUAUGAGUAAUACAUCAA | 1747 | 4393 AAUAUGAGUAAUACAUCAA | 1747 | 4411 UUGAUGUAUUACUCAUAUU | 1994 |
| 4411 | AAGAGUAGUAUUAAAAGCU | 1748 | 4411 AAGAGUAGUAUUAAAAGCU | 1748 | 4429 AGCUUUUAAUACUACUCUU | 1995 |
| 4429 | UAAUUAAUCAUGUUUAUAA | 1749 | 4429 UAAUUAAUCAUGUUUAUAA | 1749 | 4447 UUAUAAACAUGAUUAAUUA | 1996 |

VEGF NM_003376.3

| | | | | | | |
|---|---|---|---|---|---|---|
| 3 | GCGGAGGCUUGGGGCAGCC | 1997 | 3 GCGGAGGCUUGGGGCAGCC | 1997 | 21 GGCUGCCCCAAGCCUCCGC | 2093 |
| 21 | CGGGUAGCUCGAGGUCGU | 1998 | 21 CGGGUAGCUCGAGGUCGU | 1998 | 39 ACGACCUCCGAGCUACCCG | 2094 |
| 39 | UGGCGCUGGGGGCUAGCAC | 1999 | 39 UGGCGCUGGGGGCUAGCAC | 1999 | 57 GUGCUAGCCCCAGCGCCA | 2095 |
| 57 | CCAGCGCUCUGUCGGGAGG | 2000 | 57 CCAGCGCUCUGUCGGGAGG | 2000 | 75 CCUCCCGACAGAGCGCUGG | 2096 |
| 75 | GCGCAGCGGUUAGGUGGAC | 2001 | 75 GCGCAGCGGUUAGGUGGAC | 2001 | 93 GUCCACCUAACCGCUGCGC | 2097 |
| 93 | CCGGUCAGCGGACUCACCG | 2002 | 93 CCGGUCAGCGGACUCACCG | 2002 | 111 CCGUGAGUCCGCUGACCCG | 2098 |
| 111 | GGCCAGGGCGCUCGUGCU | 2003 | 111 GGCCAGGGCGCUCGUGCU | 2003 | 129 AGCACCGAGCGCCCUGGCC | 2099 |
| 129 | UGGAAUUUGAUAUUCAUUG | 2004 | 129 UGGAAUUUGAUAUUCAUUG | 2004 | 147 CAAUGAAUAUCAAAUUCCA | 2100 |
| 147 | GAUCCGGGUUUUAUCCCUC | 2005 | 147 GAUCCGGGUUUUAUCCCUC | 2005 | 165 GAGGGAUAAAACCCGGAUC | 2101 |
| 165 | CUUCUUUUUUCUUAAACAU | 2006 | 165 CUUCUUUUUUCUUAAACAU | 2006 | 183 AUGUUUAAGAAAAAAGAAG | 2102 |
| 183 | UUUUUUUUUAAAACUGUAU | 2007 | 183 UUUUUUUUUAAAACUGUAU | 2007 | 201 AUACAGUUUUAAAAAAAAA | 2103 |
| 201 | UUGUUUCUCGUUUUAAUUU | 2008 | 201 UUGUUUCUCGUUUUAAUUU | 2008 | 219 AAAUUAAAACGAGAAACAA | 2104 |
| 219 | UAUUUUUGCUUGCCAUUCC | 2009 | 219 UAUUUUUGCUUGCCAUUCC | 2009 | 237 GGAAUGGCAAGCAAAAAUA | 2105 |
| 237 | CCCACUUGAAUCGGGCCGA | 2010 | 237 CCCACUUGAAUCGGGCCGA | 2010 | 255 UCGGCCCGAUUCAAGUGGG | 2106 |
| 255 | ACGGCUGGGGAGAUUGCU | 2011 | 255 ACGGCUGGGGAGAUUGCU | 2011 | 273 AGCAAUCUCCCCAAGCCGU | 2107 |
| 273 | UCUACUUCCCCAAAUCACU | 2012 | 273 UCUACUUCCCCAAAUCACU | 2012 | 291 AGUGAUUUGGGGAAGUAGA | 2108 |
| 291 | UGUGGAUUUUGGAAACCAG | 2013 | 291 UGUGGAUUUUGGAAACCAG | 2013 | 309 CUGGUUUCCAAAAUCCACA | 2109 |
| 309 | GCAGAAAGAGGAAAGAGGU | 2014 | 309 GCAGAAAGAGGAAAGAGGU | 2014 | 327 ACCUCUUUCCUCUUUCUGC | 2110 |
| 327 | UAGCAAGAGCUCCAGAGAG | 2015 | 327 UAGCAAGAGCUCCAGAGAG | 2015 | 345 CUCUCUGGAGCUCUUGCUA | 2111 |
| 345 | GAAGUCGAGGAAGAGAGAG | 2016 | 345 GAAGUCGAGGAAGAGAGAG | 2016 | 363 CUCUCUCUUCCUCGACUUC | 2112 |
| 363 | GACGGGGUCAGAGAGAGCG | 2017 | 363 GACGGGGUCAGAGAGAGCG | 2017 | 381 CGCUCUCUCUGACCCCGUC | 2113 |
| 381 | GCGCGGGCGUGCGAGCAGC | 2018 | 381 GCGCGGGCGUGCGAGCAGC | 2018 | 399 GCUGCUCGCACGCCCGCGC | 2114 |
| 399 | CGAAAGCGACAGGGGCAAA | 2019 | 399 CGAAAGCGACAGGGGCAAA | 2019 | 417 UUUGCCCCUGUCGCUUUCG | 2115 |
| 417 | AGUGAGUGACCUGCUUUUG | 2020 | 417 AGUGAGUGACCUGCUUUUG | 2020 | 435 CAAAAGCAGGUCACUCACU | 2116 |
| 435 | GGGGGUGACCGCCGGAGCG | 2021 | 435 GGGGGUGACCGCCGGAGCG | 2021 | 453 CGCUCCGGCGGUCACCCCC | 2117 |
| 453 | GCGGCGUGAGCCCUCCCCC | 2022 | 453 GCGGCGUGAGCCCUCCCCC | 2022 | 471 GGGGGAGGGCUCACGCCGC | 2118 |
| 471 | CUUGGGAUCCCGCAGCUGA | 2023 | 471 CUUGGGAUCCCGCAGCUGA | 2023 | 489 UCAGCUGCGGGAUCCCAAG | 2119 |
| 489 | ACCAGUCGCGCUGACGGAC | 2024 | 489 ACCAGUCGCGCUGACGGAC | 2024 | 507 GUCCGUCAGCGCGACUGGU | 2120 |
| 507 | CAGACAGACAGACACCGCC | 2025 | 507 CAGACAGACAGACACCGCC | 2025 | 525 GGCGGUGUCUGUCUGUCUG | 2121 |
| 525 | CCCCAGCCCCAGCUACCAC | 2026 | 525 CCCCAGCCCCAGCUACCAC | 2026 | 543 GUGGUAGCUGGGGCUGGGG | 2122 |
| 543 | CCUCCUCCCCGGCCGGCGG | 2027 | 543 CCUCCUCCCCGGCCGGCGG | 2027 | 561 CCGCCGGCCGGGGAGGAGG | 2123 |
| 561 | GCGGACAGUGGACGCGGCG | 2028 | 561 GCGGACAGUGGACGCGGCG | 2028 | 579 CGCCGCGUCCACUGUCCGC | 2124 |
| 579 | GGCGAGCCGCGGGCAGGGG | 2029 | 579 GGCGAGCCGCGGGCAGGGG | 2029 | 597 CCCCUGCCCGCGGCUCGCC | 2125 |
| 597 | GCCGGAGCCCGCGCCCGGA | 2030 | 597 GCCGGAGCCCGCGCCCGGA | 2030 | 615 UCCGGGCGCGGGCUCCGGC | 2126 |
| 615 | AGGCGGGGUGGAGGGGUC | 2031 | 615 AGGCGGGGUGGAGGGGUC | 2031 | 633 GACCCCUCCACCCCGCCU | 2127 |
| 633 | CGGGGCUCGCGGCGUCGCA | 2032 | 633 CGGGGCUCGCGGCGUCGCA | 2032 | 651 UGCGACGCCGCGAGCCCCG | 2128 |
| 651 | ACUGAAACUUUCGUCCAA | 2033 | 651 ACUGAAACUUUCGUCCAA | 2033 | 669 UUGGACGAAAAGUUUCAGU | 2129 |
| 669 | ACUUCUGGGCUGUUCUCGC | 2034 | 669 ACUUCUGGGCUGUUCUCGC | 2034 | 687 GCGAGAACAGCCCAGAAGU | 2130 |
| 687 | CUUCGGAGGAGCCGUGGUC | 2035 | 687 CUUCGGAGGAGCCGUGGUC | 2035 | 705 GACCACGGCUCCUCCGAAG | 2131 |
| 705 | CCGCGCGGGGAAGCCGAG | 2036 | 705 CCGCGCGGGGAAGCCGAG | 2036 | 723 CUCGGCUUCCCCGCGCGG | 2132 |
| 723 | GCCGAGCGGAGCCGCGAGA | 2037 | 723 GCCGAGCGGAGCCGCGAGA | 2037 | 741 UCUCGCGGCUCCGCUCGGC | 2133 |
| 741 | AAGUGCUAGCUCGGGCCUG | 2038 | 741 AAGUGCUAGCUCGGGCCUG | 2038 | 759 CCGGCCCGAGCUAGCACUU | 2134 |
| 759 | GGAGGAGCCGCAGCCGGAG | 2039 | 759 GGAGGAGCCGCAGCCGGAG | 2039 | 777 CUCCGGCUGCGGCUCCUCC | 2135 |
| 777 | GGAGGGGGAGGAGGAAGAA | 2040 | 777 GGAGGGGGAGGAGGAAGAA | 2040 | 795 UUCUUCCUCCUCCCCCUCC | 2136 |
| 795 | AGAGAAGGAAGAGGAGAGG | 2041 | 795 AGAGAAGGAAGAGGAGAGG | 2041 | 813 CCUCUCCUCUUCCUUCUCU | 2137 |
| 813 | GGGGGCCAGUGGCGACUC | 2042 | 813 GGGGGCCAGUGGCGACUC | 2042 | 831 GAGUCGCCACUGGCCCCC | 2138 |
| 831 | CGGCGCUCGGAAGCCGGCU | 2043 | 831 CGGCGCUCGGAAGCCGGCU | 2043 | 849 GCCCGGCUUCCGAGCGCCG | 2139 |
| 849 | CUCAUGGACGGGUGAGGCG | 2044 | 849 CUCAUGGACGGGUGAGGCG | 2044 | 867 CGCCUCACCCGUCCAUGAG | 2140 |
| 867 | GGCGGUGUGCGCAGACAGU | 2045 | 867 GGCGGUGUGCGCAGACAGU | 2045 | 885 ACUGUCUGCGCACACCGCC | 2141 |
| 885 | UGCUCCAGCCGCGCGCGCU | 2046 | 885 UGCUCCAGCCGCGCGCGCU | 2046 | 903 AGCGCGCGCGGCUGGAGCA | 2142 |
| 903 | UCCCCAGGCCCUGGCCCGG | 2047 | 903 UCCCCAGGCCCUGGCCCGG | 2047 | 921 CCGGGCCAGGGCCUGGGA | 2143 |

TABLE II-continued

VEGF and/or VEGFR siNA AND TARGET SEQUENCES

| Pos | Sequence | SEQ ID | Pos | Sequence | SEQ ID | Pos | Sequence | SEQ ID |
|---|---|---|---|---|---|---|---|---|
| 921 | GGCCUCGGGCCGGGGAGGA | 2048 | 921 | GGCCUCGGGCCGGGGAGGA | 2048 | 939 | UCCUCCCCGGCCCGAGGCC | 2144 |
| 939 | AAGAGUAGCUCGCCGAGGC | 2049 | 939 | AAGAGUAGCUCGCCGAGGC | 2049 | 957 | GCCUCGGCCGAGCUACUCUU | 2145 |
| 957 | CGCCGAGGAGAGCGGGCCG | 2050 | 957 | CGCCGAGGAGAGCGGGCCG | 2050 | 975 | CGGCCCGCUCUCCUCGGCG | 2146 |
| 975 | GCCCCACAGCCCGAGCCGG | 2051 | 975 | GCCCCACAGCCCGAGCCGG | 2051 | 993 | CCGGCUCGGGCUGUGGGGC | 2147 |
| 993 | GAGAGGGAGCGCGAGCCGC | 2052 | 993 | GAGAGGGAGCGCGAGCCGC | 2052 | 1011 | GCGGCUCGCGCUCCCUCUC | 2148 |
| 1011 | CGCCGGCCCCGGUCGGGCC | 2053 | 1011 | CGCCGGCCCCGGUCGGGCC | 2053 | 1029 | GGCCCGACCGGGGCCGGCC | 2149 |
| 1029 | CUCCGAAACCAUGAACUUU | 2054 | 1029 | CUCCGAAACCAUGAACUUU | 2054 | 1047 | AAAGUUCAUGGUUUCGGAG | 2150 |
| 1047 | UCUGCUGUCUUGGGUGCAU | 2055 | 1047 | UCUGCUGUCUUGGGUGCAU | 2055 | 1065 | AUGCACCCAAGACAGCAGA | 2151 |
| 1065 | UUGGAGCCUUGCCUUGCUG | 2056 | 1065 | UUGGAGCCUUGCCUUGCUG | 2056 | 1083 | CAGCAAGGCAAGGCUCCAA | 2152 |
| 1083 | GCUCUACCUCCACCAUGCC | 2057 | 1083 | GCUCUACCUCCACCAUGCC | 2057 | 1101 | GGCAUGGUGGAGGUAGAGC | 2153 |
| 1101 | CAAGUGGUCCCAGGCUGCA | 2058 | 1101 | CAAGUGGUCCCAGGCUGCA | 2058 | 1119 | UGCAGCCUGGGACCACUUG | 2154 |
| 1119 | ACCCAUGGCAGAAGGAGGA | 2059 | 1119 | ACCCAUGGCAGAAGGAGGA | 2059 | 1137 | UCCUCCUUCUGCCAUGGGU | 2155 |
| 1137 | AGGGCAGAAUCAUCACGAA | 2060 | 1137 | AGGGCAGAAUCAUCACGAA | 2060 | 1155 | UUCGUGAUGAUUCUGCCCU | 2156 |
| 1155 | AGUGGUGAAGUUCAUGGAU | 2061 | 1155 | AGUGGUGAAGUUCAUGGAU | 2061 | 1173 | AUCCAUGAACUUCACCACU | 2157 |
| 1173 | UGUCUAUCAGCGCAGCUAC | 2062 | 1173 | UGUCUAUCAGCGCAGCUAC | 2062 | 1191 | GUAGCUGCGCUGAUAGACA | 2158 |
| 1191 | CUGCCAUCCAAUCGAGACC | 2063 | 1191 | CUGCCAUCCAAUCGAGACC | 2063 | 1209 | GGUCUCGAUUGGAUGGCAG | 2159 |
| 1209 | CCUGGUGGACAUCUUCCAG | 2064 | 1209 | CCUGGUGGACAUCUUCCAG | 2064 | 1227 | CUGGAAGAUGUCCACCAGG | 2160 |
| 1227 | GGAGUACCCUGAUGAGAUC | 2065 | 1227 | GGAGUACCCUGAUGAGAUC | 2065 | 1245 | GAUCUCAUCAGGGUACUCC | 2161 |
| 1245 | CGAGUACAUCUUCAAGCCA | 2066 | 1245 | CGAGUACAUCUUCAAGCCA | 2066 | 1263 | UGGCUUGAAGAUGUACUCG | 2162 |
| 1263 | AUCCUGUGUGCCCCUGAUG | 2067 | 1263 | AUCCUGUGUGCCCCUGAUG | 2067 | 1281 | CAUCAGGGGCACACAGGAU | 2163 |
| 1281 | GCGAUGCGGGGCUGCUGC | 2068 | 1281 | GCGAUGCGGGGCUGCUGC | 2068 | 1299 | GCAGCAGCCCCCGCAUCGC | 2164 |
| 1299 | CAAUGACGAGGGCCUGGAG | 2069 | 1299 | CAAUGACGAGGGCCUGGAG | 2069 | 1317 | CUCCAGGCCCUCGUCAUUG | 2165 |
| 1317 | GUGUGUGCCCACUGAGGAG | 2070 | 1317 | GUGUGUGCCCACUGAGGAG | 2070 | 1335 | CUCCUCAGUGGGCACACAC | 2166 |
| 1335 | GUCCAACAUCACCAUGCAG | 2071 | 1335 | GUCCAACAUCACCAUGCAG | 2071 | 1353 | CUGCAUGGUGAUGUUGGAC | 2167 |
| 1353 | GAUUAUGCGGAUCAAACCU | 2072 | 1353 | GAUUAUGCGGAUCAAACCU | 2072 | 1371 | AGGUUUGAUCCGCAUAAUC | 2168 |
| 1371 | UCACCAAGGCCAGCACAUA | 2073 | 1371 | UCACCAAGGCCAGCACAUA | 2073 | 1389 | UAUGUGCUGGCCUUGGUGA | 2169 |
| 1389 | AGGAGGAUGAGCUUCCUA | 2074 | 1389 | AGGAGGAUGAGCUUCCUA | 2074 | 1407 | UAGGAAGCUCAUCUCUCCU | 2170 |
| 1407 | ACAGCACAACAAAUGUGAA | 2075 | 1407 | ACAGCACAACAAAUGUGAA | 2075 | 1425 | UUCACAUUUGUUGUGCUGU | 2171 |
| 1425 | AUGCAGACCAAAGAAAGAU | 2076 | 1425 | AUGCAGACCAAAGAAAGAU | 2076 | 1443 | AUCUUUCUUUGGUCUGCAU | 2172 |
| 1443 | UAGAGCAAGACAAGAAAAA | 2077 | 1443 | UAGAGCAAGACAAGAAAAA | 2077 | 1461 | UUUUUCUUGUCUUGCUCUA | 2173 |
| 1461 | AAAAUCAGUUCGAGGAAAG | 2078 | 1461 | AAAAUCAGUUCGAGGAAAG | 2078 | 1479 | CUUUCCUCGAACUGAUUUU | 2174 |
| 1479 | GGGAAAGGGGCAAAAACGA | 2079 | 1479 | GGGAAAGGGGCAAAAACGA | 2079 | 1497 | UCGUUUUUGCCCCUUUCCC | 2175 |
| 1497 | AAAGCGCAAGAAAUCCCGG | 2080 | 1497 | AAAGCGCAAGAAAUCCCGG | 2080 | 1515 | CCGGGAUUUCUUGCGCUUU | 2176 |
| 1515 | GUAUAAGUCCUGGAGCGUU | 2081 | 1515 | GUAUAAGUCCUGGAGCGUU | 2081 | 1533 | AACGCUCCAGGACUUAUAC | 2177 |
| 1533 | UCCCGUGUGGCCUUGCUCA | 2082 | 1533 | UCCCGUGUGGCCUUGCUCA | 2082 | 1551 | UGAGCAAGGCCCACAGGGA | 2178 |
| 1551 | AGAGCGGAGAAAGCAUUUG | 2083 | 1551 | AGAGCGGAGAAAGCAUUUG | 2083 | 1569 | CAAAUGCUUUCUCCGCUCU | 2179 |
| 1569 | GUUUGUACAAGAUCCGCAG | 2084 | 1569 | GUUUGUACAAGAUCCGCAG | 2084 | 1587 | CUGCGGAUCUUGUACAAAC | 2180 |
| 1587 | GACGUGUAAAUGUUCCGC | 2085 | 1587 | GACGUGUAAAUGUUCCGC | 2085 | 1605 | GCAGGAACAUUUACACGUC | 2181 |
| 1605 | CAAAAACACAGACUCGCGU | 2086 | 1605 | CAAAAACACAGACUCGCGU | 2086 | 1623 | ACGCGAGUCUGUGUUUUUG | 2182 |
| 1623 | UUGCAAGGCGAGGCAGCUU | 2087 | 1623 | UUGCAAGGCGAGGCAGCUU | 2087 | 1641 | AAGCUGCCUCGCCUUGCAA | 2183 |
| 1641 | UGAGUUAAACGAACGUACU | 2088 | 1641 | UGAGUUAAACGAACGUACU | 2088 | 1659 | AGUACGUUCGUUUAACUCA | 2184 |
| 1659 | UUGCAGAUGUGACAAGCCG | 2089 | 1659 | UUGCAGAUGUGACAAGCCG | 2089 | 1677 | CGGCUUGUCACAUCUGCAA | 2185 |
| 1677 | GAGGCGGUGAGCCGGCAG | 2090 | 1677 | GAGGCGGUGAGCCGGCAG | 2090 | 1695 | CUGCCCGGCUCACCGCCUC | 2186 |
| 1695 | GGAGGAAGGAGCCUCCCUC | 2091 | 1695 | GGAGGAAGGAGCCUCCCUC | 2091 | 1713 | GAGGGAGGCUCCUUCCUCC | 2187 |
| 1703 | GAGCCUCCCUCAGGGUUUC | 2092 | 1703 | GAGCCUCCCUCAGGGUUUC | 2092 | 1721 | GAAACCCUGAGGGAGGCUC | 2188 |

Sequence Alignments: Lower case shows mismatches

| Gene | Pos | Sequence | Upper Case Seq | SEQ ID |
|---|---|---|---|---|
| hFLT1 | 3645 | AUCAUGCUGGACUGCUGGCACAG | AUCAUGCUGGACUGCUGGCACAG | 2189 |
| hKDR | 3717 | AcCAUGCUGGACUGCUGGCACgG | ACCAUGCUGGACUGCUGGCACGG | 2190 |
| mFLT1 | 3422 | AUCAUGUUGGAUUGCUGGCACAa | AUCAUGUUGGAUUGCUGGCACAA | 2191 |
| mKDR | 3615 | AcCAUGCUGGACUGCUGGCAUga | ACCAUGCUGGACUGCUGGCAUGA | 2192 |
| rFLT1 | 3632 | AUCAUGCUGGAUUGCUGGCACAa | AUCAUGCUGGAUUGCUGGCACAA | 2193 |
| rKDR | 3650 | ACCAUGCUGGAUUGCUGGCAUga | ACCAUGCUGGAUUGCUGGCAUGA | 2194 |
| hFLT1 | 3646 | UCAUGCUGGACUGCUGGCACAGA | UCAUGCUGGACUGCUGGCACAGA | 2195 |
| hKDR | 3718 | cCAUGCUGGACUGCUGGCACgGg | CCAUGCUGGACUGCUGGCACGGG | 2196 |
| mFLT1 | 3423 | UCAUGUUGGAUUGCUGGCACAaA | UCAUGUUGGAUUGCUGGCACAAA | 2197 |
| mKDR | 3616 | cCAUGCUGGACUGCUGGCAUgag | CCAUGCUGGACUGCUGGCAUGAG | 2198 |
| rFLT1 | 3633 | UCAUGCUGGAUUGCUGGCACAaA | UCAUGCUGGAUUGCUGGCACAAA | 2199 |
| rKDR | 3651 | CCAUGCUGGAUUGCUGGCAUgag | CCAUGCUGGAUUGCUGGCAUGAG | 2200 |
| hFLT1 | 3647 | CAUGCUGGACUGCUGGCACAGAG | CAUGCUGGACUGCUGGCACAGAG | 2201 |
| hKDR | 3719 | CAUGCUGGACUGCUGGCACgGgG | CAUGCUGGACUGCUGGCACGGGG | 2202 |
| mFLT1 | 3424 | CAUGUUGGAUUGCUGGCACAaAG | CAUGUUGGAUUGCUGGCACAAAG | 2203 |
| mKDR | 3617 | CAUGCUGGACUGCUGGCAUgagG | CAUGCUGGACUGCUGGCAUGAGG | 2204 |
| rFLT1 | 3634 | CAUGCUGGAUUGCUGGCACAaAG | CAUGCUGGAUUGCUGGCACAAAG | 2205 |
| rKDR | 3652 | CAUGCUGGAUUGCUGGCAUgagG | CAUGCUGGAUUGCUGGCAUGAGG | 2206 |
| hKDR | 2764 | UGCCUUAUGAUGCCAGCAAAUGG | UGCCUUAUGAUGCCAGCAAAUGG | 2207 |
| hFLT1 | 2689 | UcCCUUAUGAUGCCAGCAAgUGG | UCCCUUAUGAUGCCAGCAAGUGG | 2208 |
| mFLT1 | 2469 | UGCCUUAUGAUGCCAGCAAgUGG | UGCCUUAUGAUGCCAGCAAGUGG | 2209 |
| mKDR | 2662 | UGCCUUAUGAUGCCAGCAAgUGG | UGCCUUAUGAUGCCAGCAAGUGG | 2210 |
| rFLT1 | 2676 | UGCCcUAUGAUGCCAGCAAgUGG | UGCCCUAUGAUGCCAGCAAGUGG | 2209 |
| rKDR | 2697 | UGCCUUAUGAUGCCAGCAAgUGG | UGCCUUAUGAUGCCAGCAAGUGG | 2210 |
| hKDR | 2765 | GCCUUAUGAUGCCAGCAAAUGGG | GCCUUAUGAUGCCAGCAAAUGGG | 2211 |
| hFLT1 | 2690 | cCCUUAUGAUGCCAGCAAgUGGG | CCCUUAUGAUGCCAGCAAGUGGG | 2212 |

TABLE II-continued

VEGF and/or VEGFR siNA AND TARGET SEQUENCES

| Gene | Pos | Sequence | Target | SeqID |
|---|---|---|---|---|
| mFLT1 | 2470 | GCCCUAUGAUGCCAGCAAgUGGG | GCCCUAUGAUGCCAGCAAGUGGG | 2213 |
| mKDR | 2663 | GCCUUAUGAUGCCAGCAAgUGGG | GCCUUAUGAUGCCAGCAAGUGGG | 2214 |
| rFLT1 | 2677 | GCCCUAUGAUGCCAGCAAgUGGG | GCCCUAUGAUGCCAGCAAGUGGG | 2213 |
| rKDR | 2698 | GCCUUAUGAUGCCAGCAAgUGGG | GCCUUAUGAUGCCAGCAAGUGGG | 2214 |
| hKDR | 2766 | CCUUAUGAUGCCAGCAAAUGGGA | CCUUAUGAUGCCAGCAAAUGGGA | 2215 |
| hFLT1 | 2691 | CCUUAUGAUGCCAGCAAgUGGGA | CCUUAUGAUGCCAGCAAGUGGGA | 2216 |
| mFLT1 | 2471 | CCcUAUGAUGCCAGCAAgUGGGA | CCCUAUGAUGCCAGCAAGUGGGA | 2217 |
| mKDR | 2664 | CCUUAUGAUGCCAGCAAgUGGGA | CCUUAUGAUGCCAGCAAGUGGGA | 2216 |
| rFLT1 | 2678 | CCcUAUGAUGCCAGCAAgUGGGA | CCCUAUGAUGCCAGCAAGUGGGA | 2217 |
| rKDR | 2699 | CCUUAUGAUGCCAGCAAgUGGGA | CCUUAUGAUGCCAGCAAGUGGGA | 2216 |
| hKDR | 2767 | CUUAUGAUGCCAGCAAAUGGGAA | CUUAUGAUGCCAGCAAAUGGGAA | 2218 |
| hFLT1 | 2692 | CUUAUGAUGCCAGCAAgUGGGAg | CUUAUGAUGCCAGCAAGUGGGAG | 2219 |
| mFLT1 | 2472 | CcUAUGAUGCCAGCAAgUGGGAg | CCUAUGAUGCCAGCAAGUGGGAG | 2220 |
| mKDR | 2665 | CUUAUGAUGCCAGCAAgUGGGAA | CUUAUGAUGCCAGCAAGUGGGAA | 2221 |
| rFLT1 | 2679 | CcUAUGAUGCCAGCAAgUGGGAg | CCUAUGAUGCCAGCAAGUGGGAG | 2220 |
| rKDR | 2700 | CUUAUGAUGCCAGCAAgUGGGAg | CUUAUGAUGCCAGCAAGUGGGAG | 2219 |
| hKDR | 2768 | UUAUGAUGCCAGCAAAUGGGAAU | UUAUGAUGCCAGCAAAUGGGAAU | 2222 |
| hFLT1 | 2693 | UUAUGAUGCCAGCAAgUGGGAgU | UUAUGAUGCCAGCAAGUGGGAGU | 2223 |
| mFLT1 | 2473 | cUAUGAUGCCAGCAAgUGGGAgu | CUAUGAUGCCAGCAAGUGGGAGU | 2224 |
| mKDR | 2666 | UUAUGAUGCCAGCAAgUGGGAAU | UUAUGAUGCCAGCAAGUGGGAAU | 2225 |
| rFLT1 | 2680 | cUAUGAUGCCAGCAAgUGGGAgU | CUAUGAUGCCAGCAAGUGGGAGU | 2224 |
| rKDR | 2701 | UUAUGAUGCCAGCAAQUGGGAQU | UUAUGAUGCCAGCAAGUGGGAGU | 2223 |
| hKDR | 3712 | ACCAGACCAUGCUGGACUGCUGG | ACCAGACCAUGCUGGACUGCUGG | 2226 |
| hFLT1 | 3640 | AUCAGAUCAUGCUGGACUGCUGG | AUCAGAUCAUGCUGGACUGCUGG | 2227 |
| mFLT1 | 3417 | ACCAaAUCAUGUUGGAUUGCUGG | ACCAAAUCAUGUUGGAUUGCUGG | 2228 |
| mKDR | 3610 | ACCAGACCAUGCUGGACUGCUGG | ACCAGACCAUGCUGGACUGCUGG | 2226 |
| rFLT1 | 3627 | ACCAaAUCAUGCUGGAUUGCUGG | ACCAAAUCAUGCUGGAUUGCUGG | 2229 |
| rKDR | 3645 | ACCAaACCAUGCUGGAUUGCUGG | ACCAAACCAUGCUGGAUUGCUGG | 2230 |
| hKDR | 3713 | CCAGACCAUGCUGGACUGCUGGC | CCAGACCAUGCUGGACUGCUGGC | 2231 |
| hFLT1 | 3641 | UCAGAUCAUGCUGGACUGCUGGC | UCAGAUCAUGCUGGACUGCUGGC | 2232 |
| mFLT1 | 3418 | CCAaAUCAUGUUGGAUUGCUGGC | CCAAAUCAUGUUGGAUUGCUGGC | 2233 |
| mKDR | 3611 | CCAGACCAUGCUGGACUGCUGGC | CCAGACCAUGCUGGACUGCUGGC | 2231 |
| rFLT1 | 3628 | CCAaAUCAUGCUGGAUUGCUGGC | CCAAAUCAUGCUGGAUUGCUGGC | 2234 |
| rKDR | 3646 | CCAaACCAUGCUGGAUUGCUGGC | CCAAACCAUGCUGGAUUGCUGGC | 2235 |
| hKDR | 3714 | CAGACCAUGCUGGACUGCUGGCA | CAGACCAUGCUGGACUGCUGGCA | 2236 |
| hFLT1 | 3642 | CAGAUCAUGCUGGACUGCUGGCA | CAGAUCAUGCUGGACUGCUGGCA | 2237 |
| mFLT1 | 3419 | CAaAUCAUGUUGGAUUGCUGGCA | CAAAUCAUGUUGGAUUGCUGGCA | 2238 |
| mKDR | 3612 | CAGACCAUGCUGGACUGCUGGCA | CAGACCAUGCUGGACUGCUGGCA | 2236 |
| rFLT1 | 3629 | CAaAUCAUGCUGGAUUGCUGGCA | CAAAUCAUGCUGGAUUGCUGGCA | 2239 |
| rKDR | 3647 | CAaACCAUGCUGGAUUGCUGGCA | CAAACCAUGCUGGAUUGCUGGCA | 2240 |
| hKDR | 3715 | AGACCAUGCUGGACUGCUGGCAC | AGACCAUGCUGGACUGCUGGCAC | 2241 |
| hFLT1 | 3643 | AGAUCAUGCUGGACUGCUGGCAC | AGAUCAUGCUGGACUGCUGGCAC | 2242 |
| mFLT1 | 3420 | AaAUCAUGUUGGAUUGCUGGCAC | AAAUCAUGUUGGAUUGCUGGCAC | 2243 |
| mKDR | 3613 | AGACCAUGCUGGACUGCUGGCAU | AGACCAUGCUGGACUGCUGGCAU | 2244 |
| rFLT1 | 3630 | AaAUCAUGCUGGAUUGCUGGCAC | AAAUCAUGCUGGAUUGCUGGCAC | 2245 |
| rKDR | 3648 | AaACCAUGCUGGAUUGCUGGCAU | AAACCAUGCUGGAUUGCUGGCAU | 2246 |
| hKDR | 3716 | GACCAUGCUGGACUGCUGGCACG | GACCAUGCUGGACUGCUGGCACG | 2247 |
| hFLT1 | 3644 | GAUCAUGCUGGACUGCUGGCACa | GAUCAUGCUGGACUGCUGGCACA | 2248 |
| mFLT1 | 3421 | aAUCAUGUUGGAUUGCUGGCACa | AAUCAUGUUGGAUUGCUGGCACA | 2249 |
| mKDR | 3614 | GACCAUGCUGGACUGCUGGCAUG | GACCAUGCUGGACUGCUGGCAUG | 2250 |
| rFLT1 | 3631 | aAUCAUGCUGGAUUGCUGGCACa | AAUCAUGCUGGAUUGCUGGCACA | 2251 |
| rKDR | 3649 | aACCAUGCUGGAUUGCUGGCAUG | AACCAUGCUGGAUUGCUGGCAUG | 2252 |
| hKDR | 3811 | AGCAGGAUGGCAAAGACUACAUU | AGCAGGAUGGCAAAGACUACAUU | 2253 |
| hFLT1 | 3739 | AaCAGGAUGGUAAAGACUACAUc | AACAGGAUGGUAAAGACUACAUC | 2254 |
| mFLT1 | 3516 | AaCAGGAUGGgAAAGAUUACAUc | AACAGGAUGGGAAAGAUUACAUC | 2255 |
| mKDR | 3709 | AGCAGGAUGGCAAAGACUAUAUU | AGCAGGAUGGCAAAGACUAUAUU | 2256 |
| rFLT1 | 3726 | AaCAGGAUGGUAAAGACUACAUc | AACAGGAUGGUAAAGACUACAUC | 2254 |
| rKDR | 3744 | AGCAGGAUGGCAAAGACUAUAUU | AGCAGGAUGGCAAAGACUAUAUU | 2256 |
| hKDR | 3812 | GCAGGAUGGCAAAGACUACAUUG | GCAGGAUGGCAAAGACUACAUUG | 2257 |
| hFLT1 | 3740 | aCAGGAUGGUAAAGACUACAUcc | ACAGGAUGGUAAAGACUACAUCC | 2258 |
| mFLT1 | 3517 | aGAGGAUGGgAAAGAUUACAUcc | AGAGGAUGGGAAAGAUUACAUCC | 2259 |
| mKDR | 3710 | GCAGGAUGGCAAAGACUAUAUUG | GCAGGAUGGCAAAGACUAUAUUG | 2260 |
| rFLT1 | 3727 | aCAGGAUGGUAAAGACUACAUcc | ACAGGAUGGUAAAGACUACAUCC | 2258 |
| rKDR | 3745 | GCAGGAUGGCAAAGACUAUAUUG | GCAGGAUGGCAAAGACUAUAUUG | 2260 |

Conserved Regions

| Gene | Pos | Len | Sequence | SeqID |
|---|---|---|---|---|

Fragments of >= 10 nt that are present in both human VEGF (NM_003376.3) and human FLT1 (NM_002019.1)

| Gene | Pos | Len | Sequence | SeqID |
|---|---|---|---|---|
| FLT1 | 18 | 12 | CUCCUCCCCGGC | 2261 |
| FLT1 | 125 | 12 | GGAGCCGCGAGA | 2262 |
| FLT1 | 155 | 12 | GGCCGGCGGCGG | 2263 |
| FLT1 | 160 | 10 | GCGGCGGCGA | 2264 |
| FLT1 | 1051 | 11 | UACCCUGAUGA | 2265 |
| FLT1 | 1803 | 10 | GGCUAGCACC | 2266 |

TABLE II-continued

VEGF and/or VEGFR siNA AND TARGET SEQUENCES

| FLT1 | 2841 | 10 | AGAGGGGGCC | 2267 |
| FLT1 | 3133 | 12 | AGCAGCGAAAGC | 2268 |
| FLT1 | 3191 | 11 | AGGAAGAGGAG | 2269 |
| FLT1 | 3550 | 10 | CCAGGAGUAC | 2270 |
| FLT1 | 4216 | 10 | CCGCCCCCAG | 2271 |
| FLT1 | 5711 | 10 | GUGGGCCUUG | 2272 |
| FLT1 | 5811 | 10 | GUGGGCCUUG | 2272 |
| FLT1 | 5938 | 10 | CUUGGGGAGA | 2273 |
| FLT1 | 6236 | 10 | CCUCUUCUUU | 2274 |

Fragments of >= 10 nt that are present in both human VEGF (NM_003376.3) and human KDR (NM_002253.1)

| KDR | 1463 | 10 | AAGUGAGUGA | 2275 |
| KDR | 1689 | 11 | GGAGGAAGAGU | 2276 |
| KDR | 1886 | 11 | ACAAAUGUGAA | 2277 |
| KDR | 1983 | 10 | GOCCACUGAG | 2278 |
| KDR | 2228 | 10 | GCCUUGCUCA | 2279 |
| KDR | 2484 | 10 | GAGGAAGGAG | 2280 |
| KDR | 3064 | 10 | UUUGGAAACC | 2281 |
| KDR | 3912 | 11 | GGAGGAGGAAG | 2282 |
| KDR | 4076 | 10 | CGGACAGUGG | 2283 |
| KDR | 5138 | 10 | UCCCAGGCUG | 2284 |

Figure 4:
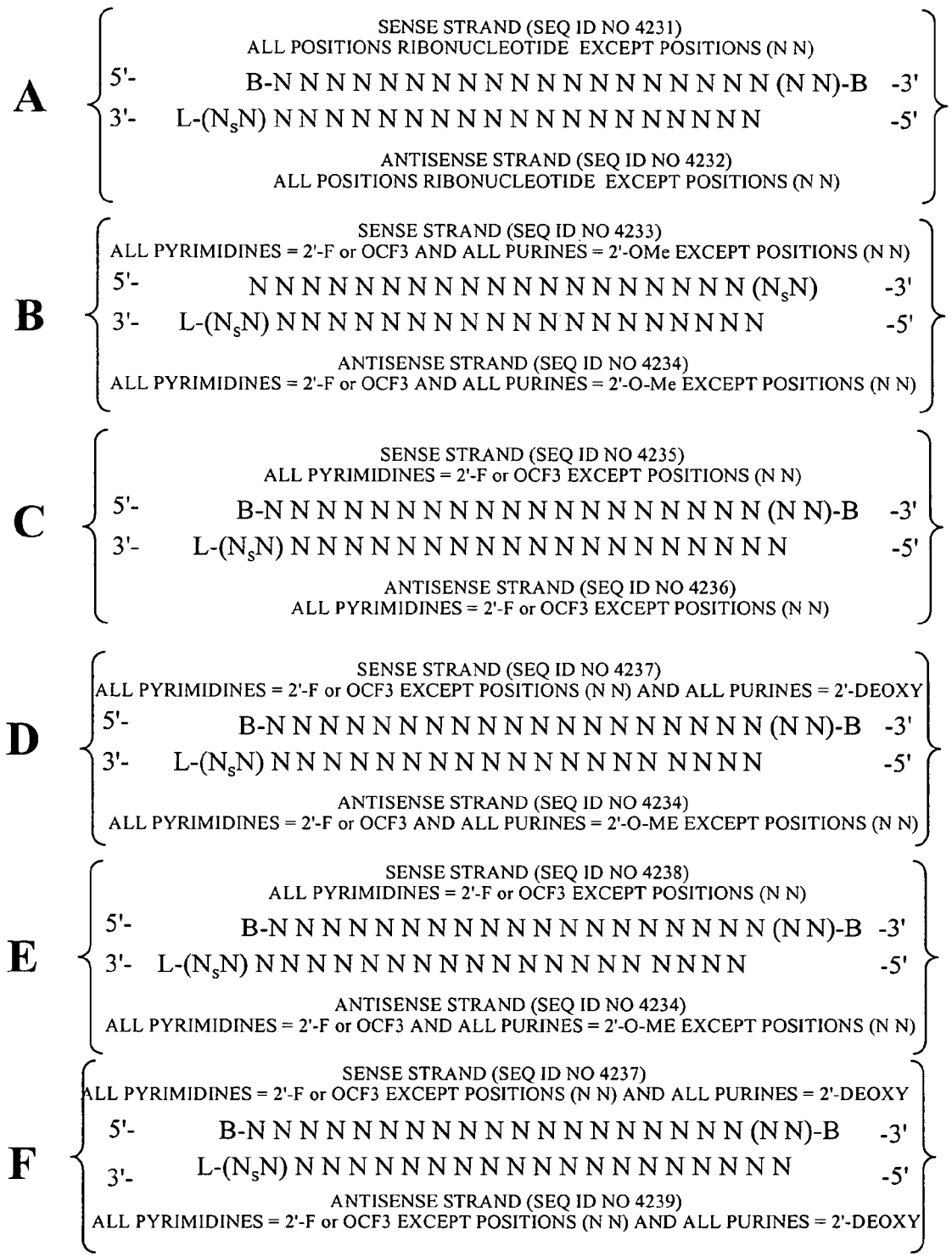
FIG. 4A-F shows non-limiting examples of chemically-modified siNA constructs of the present invention. In the figure, N stands for any nucleotide (adenosine, guanosine, cytosine, uridine, or optionally thymidine, for example thymidine can be substituted in the overhanging regions designated by parenthesis (N N). Various modifications are shown for the sense and antisense strands of the siNA constructs. The (N N) nucleotide positions can be chemically modified as described herein (e.g., 2'-O-methyl, 2'-deoxy-2'-fluoro etc.) and can be either derived from a corresponding target nucleic acid sequence or not (see for example FIG. 6C). Furthermore, the sequences shown in FIG. 4 can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand (see FIG. 6C).
Figure 5:
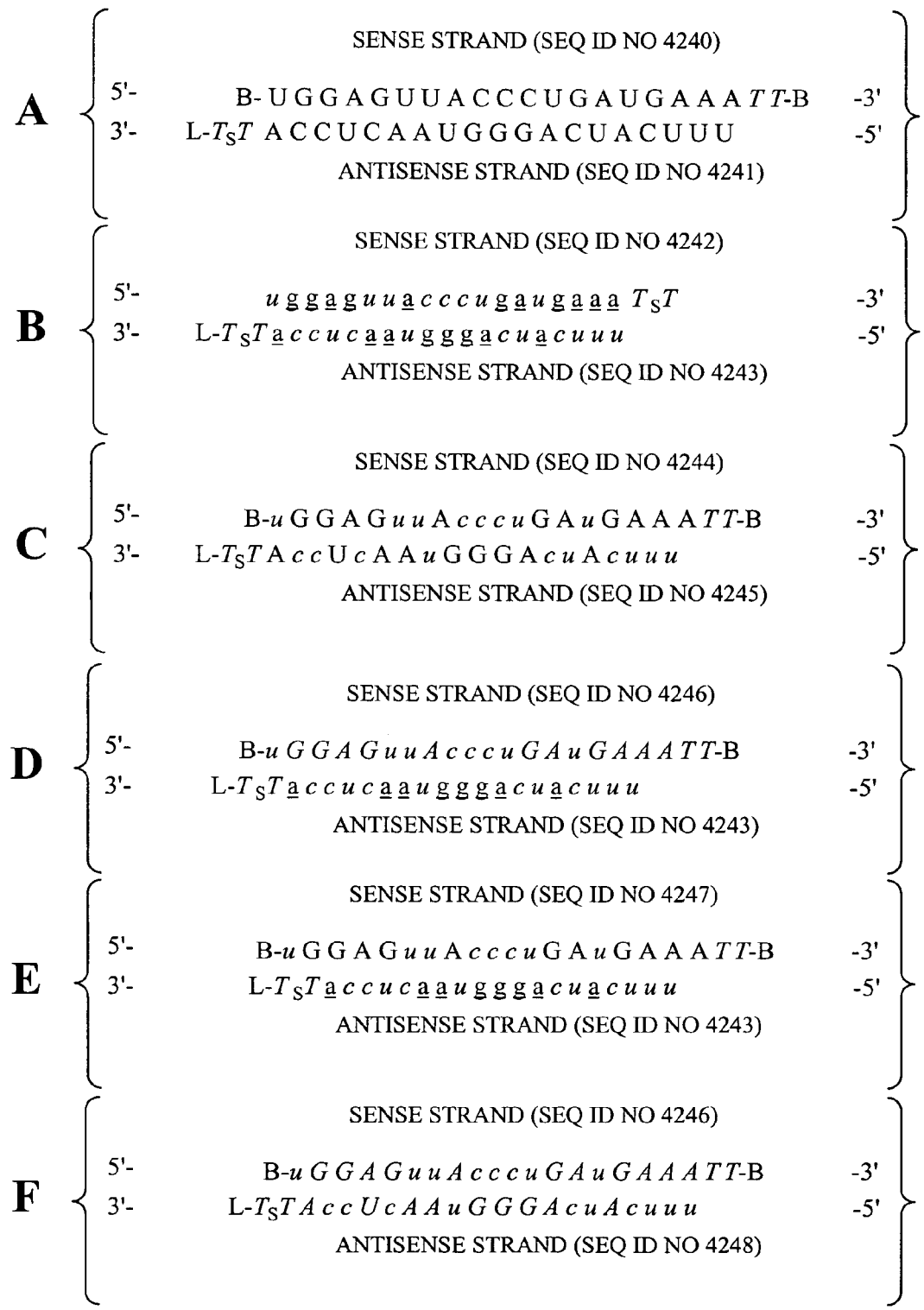
FIG. 5A-F shows non-limiting examples of specific chemically-modified siNA sequences of the invention. A-F applies the chemical modifications described in FIG. 4A-F to an exemplary VEGF and/or VEGFR target siNA sequence. Such chemical modifications can be applied to any VEGF and/or VEGFR target or other target polynucleotide sequence.

The 3'-ends of the Upper sequence and the Lower sequence of the siNA construct can include an overhang sequence, for example about 1, 2, 3, or 4 nucleotides in length, preferably 2 nucleotides in length, wherein the overhanging sequence of the lower sequence is optionally complementary to a portion of the target sequence. The upper and lower sequences in the Table can further comprise a chemical modification having Formulae I-VII, such as exemplary siNA constructs shown in FIGS. 4 and 5, or having modifications described in Table IV or any combination thereof.

TABLE III

VEGF and/or VEGFR Synthetic Modified siNA Constructs

| Target Pos | Target | Seq ID | Cmpd # | Aliases | Sequence | Seq ID |
|---|---|---|---|---|---|---|
| VEGFR1 | | | | | | |
| 298 | GCUGUCUGCUUCUCACAGGAUCU | 2285 | | FLT1:298U21 sense siNA | UGUCUGCUUCUCACAGGAUTT | 2709 |
| 1956 | GAAGGAGAGGACCUGAAACUGUC | 2286 | | FLT1:1956U21 sense siNA | AGGAGAGGACCUGAAACUGTT | 2710 |
| 1957 | AAGGAGAGGACCUGAAACUGUCU | 2287 | | FLT1:1957U21 sense siNA | GGAGAGGACCUGAAACUGUTT | 2711 |
| 2787 | GCAUUGGCAUUAAGAAAUCACC | 2288 | | FLT1:2787U21 sense siNA | AUUUGGCAUUAAGAAAUCATT | 2712 |
| 298 | GCUGUCUGCUUCUCACAGGAUCU | 2285 | | FLT1:316L21 antisense siNA (298 C.) | AUCCUGUGAGAAGCAGACATT | 2713 |
| 1956 | GAAGGAGAGGACCUGAAACUGUC | 2286 | | FLT1:1974L21 antisense siNA (1956 C.) | CAGUUUCAGGUCCUCUCCUTT | 2714 |
| 1957 | AAGGAGAGGACCUGAAACUGUCU | 2287 | | FLT1:1975L21 antisense siNA (1957 C.) | ACAGUUUCAGGUCCUCUCCTT | 2715 |
| 2787 | GCAUUGGCAUUAAGAAAUCACC | 2288 | | FLT1:2805L21 antisense siNA (2787 C.) | UGAUUUCUUAAUGCCAAAUT | 2716 |
| 298 | GCUGUCUGCUUCUCACAGGAUCU | 2285 | | FLT1:298U21 sense siNA stab04 | B uGucUGcuucucAcAGGAuTT | 2717 |
| 1956 | GAAGGAGAGGACCUGAAACUGUC | 2286 | | FLT1:1956U21 sense siNA stab04 | B AGGAGAGGAccugAAAcuGTT | 2718 |
| 1957 | AAGGAGAGGACCUGAAACUGUCU | 2287 | | FLT1:1957U21 sense siNA stab04 | B GGAGAGGAccugAAAcuGuTT | 2719 |
| 2787 | GCAUUGGCAUUAAGAAAUCACC | 2288 | | FLT1:2787U21 sense siNA stab04 | B AuuuGGcAuuAAGAAAucATT | 2720 |
| 298 | GCUGUCUGCUUCUCACAGGAUCU | 2285 | | FLT1:316L21 antisense siNA (298 C.) stab05 | AuccuGuGAGAAGcAGAcATsT | 2721 |
| 1956 | GAAGGAGAGGACCUGAAACUGUC | 2286 | | FLT1:1974L21 antisense siNA (1956 C.) stab05 | cAGuuucAGGuccucuccuTsT | 2722 |
| 1957 | AAGGAGAGGACCUGAAACUGUCU | 2287 | | FLT1:1975L21 antisense siNA (1957 C.) stab05 | AcAGuuucAGGuccucuccTsT | 2723 |
| 2787 | GCAUUGGCAUUAAGAAAUCACC | 2288 | | FLT1:2805L21 antisense siNA (2787 C.) stab05 | uGAuuucuuAAuGccAAAuTsT | 2724 |
| 298 | GCUGUCUGCUUCUCACAGGAUCU | 2285 | | FLT1:298U21 sense siNA stab07 | B uGucUGcuucucAcAGGAuTT | 2725 |
| 1956 | GAAGGAGAGGACCUGAAACUGUC | 2286 | 37387 | FLT1:1956U21 sense siNA stab07 | B AGGAGAGGAccugAAAcuGTT | 2726 |
| 1957 | AAGGAGAGGACCUGAAACUGUCU | 2287 | 37388 | FLT1:1957U21 sense siNA stab07 | B GGAGAGGAccugAAAcuGuTT | 2727 |
| 2787 | GCAUUGGCAUUAAGAAAUCACC | 2288 | 37404 | FLT1:2787U21 sense siNA stab07 | B AuuuGGcAuuAAGAAAucATT | 2728 |
| 298 | GCUGUCUGCUUCUCACAGGAUCU | 2285 | | FLT1:316L21 antisense siNA (298 C.) stab11 | AuccuGuGAGAAGcAGAcATsT | 2729 |
| 1956 | GAAGGAGAGGACCUGAAACUGUC | 2286 | | FLT1:1974L21 antisense siNA (1956 C.) stab11 | cAGuuucAGGuccucuccuTsT | 2730 |
| 1957 | AAGGAGAGGACCUGAAACUGUCU | 2287 | | FLT1:1975L21 antisense siNA (1957 C.) stab11 | AcAGuuucAGGuccucuccTsT | 2731 |
| 2787 | GCAUUGGCAUUAAGAAAUCACC | 2288 | | FLT1:2805L21 antisense siNA (2787 C.) stab11 | uGAuuucuuAAuGccAAAuTsT | 2732 |
| 349 | AACUGAGUUUAAAAGGCACCCAG | 2289 | 31209 | FLT1:367L21 antisense siNA (349 C.) stab05 inv | GAcucAAAuuuucCGuGGGTsT | 2733 |
| 2949 | AAGCAAGGAGGGCCUCUGAUGGU | 2290 | 31210 | FLT1:2967L21 antisense siNA (2949 C.) stab05 inv | cGuuccccGGAcuAcTsT | 2734 |
| 3912 | AGCCUGGAAGAAGAUCAAAACCUU | 2291 | 31211 | FLT1:3930L21 antisense siNA (3912 C.) stab05 inv | GGAcuuucuuAGuuuuGGTsT | 2735 |
| 349 | AACUGAGUUUAAAAGGCACCCAG | 2289 | 31212 | FLT1:349U21 sense siNA stab07 inv | B ccCACGGAAAAuuuuGAGucTT | 2736 |
| 2949 | AAGCAAGGAGGGCCUCUGAUGGU | 2290 | 31213 | FLT1:2949U21 sense siNA stab07 inv | B GuAGuccGGGAGMcGTT | 2737 |
| 3912 | AGCCUGGAAGAAGAUCAAAACCU | 2291 | 31214 | FLT1:3912U21 sense siNA stab07 inv | B ccAAAAcuAAGAAAGGuccTT | 2738 |
| 349 | AACUGAGUUUAAAAGGCACCCAG | 2289 | 31215 | FLT1:367L21 antisense siNA (349 C.) stab08 inv | GAcucAAAuuuucc GuGGGTsT | 2739 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2949 | AAGCAAGGAGGGCCUCUGAUGGU | 2290 | 31216 | FLT1:2967L21 antisense siNA (2949 C.) cGuccucucc GGAGAcuAcTsT stab08 inv | 2740 | |
| 3912 | AGCCUGGAAAGAAUCAAAACCUU | 2291 | 31217 | FLT1:3930L21 antisense siNA (3912 C.) GGAccuuucuu AGuuuuGGTsT stab08 inv | 2741 | |
| 349 | AACUGAGUUUAAAAGGCACCCAG | 2289 | 31270 | FLT1:349U21 sense siNA stab09 | B CUGAGUUUAAAAGGCACCCTT | 2742 |
| 2949 | AAGCAAGGAGGGCCUCUGAUGGU | 2290 | 31271 | FLT1:2949U21 sense siNA stab09 | B GCAAGGAGGGCCUCUGAUGTT | 2743 |
| 3912 | AGCCUGGAAAGAAUCAAAACCUU | 2291 | 31272 | FLT1:3912U21 sense siNA stab09 | B CCUGGAAAGAAUCAAAACCTT | 2744 |
| 349 | AACUGAGUUUAAAAGGCACCCAG | 2289 | 31273 | FLT1:367L21 antisense siNA (349 C.) GGGUGCCUU-UUAAACUCAGTsT stab10 | 2745 | |
| 2949 | AAGCAAGGAGGGCCUCUGAUGGU | 2290 | 31274 | FLT1:2967L21 antisense siNA (2949 C.) CAUCAGAGGC-CCUCCUUGCTsT stab10 | 2746 | |
| 3912 | AGCCUGGAAAGAAUCAAAACCUU | 2291 | 31275 | FLT1:3930L21 antisense siNA (3912 C.) GGUUUUGAUUCU-UUCCAGTsT stab10 | 2747 | |
| 349 | AACUGAGUUUAAAAGGCACCCAG | 2289 | 31276 | FLT1:349U21 sense siNA stab09 inv | B CCCACGAAAUUUGAGUCTT | 2748 |
| 2949 | AAGCAAGGAGGGCCUCUGAUGGU | 2290 | 31277 | FLT1:2949U21 sense siNA stab09 inv | B GUAGUCUCCGGAGGAACGTT | 2749 |
| 3912 | AGCCUGGAAAGAAUCAAAACCUU | 2291 | 31278 | FLT1:3912U21 sense siNA stab09 inv | B CCAAAACUAAGAAAGUCCTT | 2750 |
| 349 | AACUGAGUUUAAAAGGCACCCAG | 2289 | 31279 | FLT1:367L21 antisense siNA (349 C.) stab10 inv | GACUCAAAUUUCCGUGGGTsT | 2751 |
| 2949 | AAGCAAGGAGGGCCUCUGAUGGU | 2290 | 31280 | FLT1:2967L21 antisense siNA (2949 C.) stab10 inv | CGUCCUCCGCGGAGACUACTsT | 2752 |
| 3912 | AGCCUGGAAAGAAUCAAAACCUU | 2291 | 31281 | FLT1:3930L21 antisense siNA (3912 C.) stab10 inv | GGACCUUUCUUAGAUUUUGTsT | 2753 |
| 2340 | AACAACCACAAAAUACAACAAGA | 2292 | 31424 | FLT1:2358L21 antisense siNA (2340 C.) stab11 3'-BrdU | uuGuGlAuuuuGuGGuuGXsX | 2754 |
| 2949 | AAGCAAGGAGGGCCUCUGAUGGU | 2290 | 31425 | FLT1:2967L21 antisense siNA (2949 C.) stab11 3'-BrdU | cAucAGAGGccccuuGcXsX | 2755 |
| 2340 | AACAACCACAAAAUACAACAAGA | 2292 | 31442 | FLT1:2358L21 antisense siNA (2340 C.) stab11 3'-BrdU | uuGuGlAuuuuGuGGuuGXsT | 2756 |
| 2949 | AAGCAAGGAGGGCCUCUGAUGGU | 2290 | 31443 | FLT1:2967L21 antisense siNA (2949 C.) stab11 3'-BrdU | cAucAGAGGccccuuGcXsT | 2757 |
| 2340 | AACAACCACAAAAUACAACAAGA | 2292 | 31449 | FLT1:2340U21 sense siNA stab09 | B CAACCACAAAAUACAACAATT | 2758 |
| 2340 | AACAACCACAAAAUACAACAAGA | 2292 | 31450 | FLT1:2340U21 sense siNA inv stab09 | B AACAACAUAAAACACCAACTT | 2759 |
| 2340 | AACAACCACAAAAUACAACAAGA | 2292 | 31451 | FLT1:2358L21 antisense siNA (2340 C.) stab10 | UUGUUGUAUUUUGUGGUUGTsT | 2760 |
| 2340 | AACAACCACAAAAUACAACAAGA | 2292 | 31452 | FLT1:2358L21 antisense siNA (2340 C.) inv stab10 | GUUGUGUUUUAUGUUGUUUsT | 2761 |
| 2340 | AACAACCACAAAAUACAACAAGA | 2292 | 31509 | FLT1:2358L21 antisense siNA (2340 C.) stab11 | uuGuuGuAuuuuGuGGuuGTsT | 2762 |
| 349 | AACUGAGUUUAAAAGGCACCCAG | 2289 | 31794 | 2 x cholesterol + R31194 FLT1:349U21 sense siNA stab07 | (H)2 ZTa B cuGAGuuuAAAAGGCAcccTT | 2763 |
| 349 | AACUGAGUUUAAAAGGCACCCAG | 2289 | 31795 | 2 x cholesterol + R31212 FLT1:349U21 sense siNA stab07 inv | (H)2 ZTa B cccAcGGAAAuuuGAGucTT | 2764 |
| 349 | AACUGAGUUUAAAAGGCACCCAG | 2289 | 31796 | 2 x cholesterol + 31270 FLT1:349U21 | (H)2 ZTA B | 2765 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 349 | AACUGAGUUUAAAAGGCACCCAG | 2289 | 31797 | sense siNA stab09 | CUGAGUUUAAAAGGCACCCTT (H)2 ZTA B | 2766 |
| 349 | AACUGAGUUUAAAAGGCACCCAG | 2289 | 31798 | 2 x cholesterol + R31276 FLT1:349U21 sense siNA stab09 inv | CCCACGGAAAAUUUGAGUCTT (L)2 ZTa B | 2767 |
| 349 | AACUGAGUUUAAAAGGCACCCAG | 2289 | 31799 | 2 x C18 phospholipid + R31194 FLT1:349U21 sense siNA stab07 | cuGAGuuuAAAAGGcAcccTT (L)2 ZTa B | 2768 |
| 349 | AACUGAGUUUAAAAGGCACCCAG | 2289 | 31800 | 2 x C18 phospholipid + R31212 FLT1:349U21 sense siNA stab07 inv | cccAcGGAAAAuuuGAGucTT (L)2 ZTA B | 2769 |
| 349 | AACUGAGUUUAAAAGGCACCCAG | 2289 | 31801 | 2 x C18 phospholipid + R31270 FLT1:349U21 sense siNA stab09 | CUGAGUUUAAAAGGCACCCTT (L)2 ZTA B | 2770 |
| 349 | AACUGAGUUUAAAAGGCACCCAG | 2289 | | 2 x C18 phospholipid + R31276 FLT1:349U21 sense siNA stab09 inv | CCCACGGAAAAUUUGAGUCTT (L)2 ZTA B | 2771 |
| 3645 | CAUGCUGGACUGCUGGCAC | 2293 | 32235 | FLT1:3645U21 sense siNA | CAUGCUGGACUGCUGGCACTT | 2772 |
| 3646 | AUGCUGGACUGCUGGCACA | 2294 | 32236 | FLT1:3646U21 sense siNA | AUGCUGGACUGCUGGCACATT | 2773 |
| 3647 | UGCUGGACUGCUGGCACAG | 2295 | 32237 | FLT1:3647U21 sense siNA | UGCUGGACUGCUGGCACAGTT | 2774 |
| 3645 | CAUGCUGGACUGCUGGCAC | 2293 | 32250 | FLT1:3663L21 antisense siNA (3645 C.) | GUGCCAGCAGUCCAGCAUGTT | 2775 |
| 3646 | AUGCUGGACUGCUGGCACA | 2294 | 32251 | FLT1:3664L21 antisense siNA (3646 C.) | UGUGCCAGCAGUCCAGCAUTT | 2776 |
| 3647 | UGCUGGACUGCUGGCACAG | 2295 | 32252 | FLT1:3665L21 antisense siNA (3647 C.) | CUGUGCCAGCAGUCCAGCATT | 2777 |
| 349 | AACUGAGUUUAAAAGGCACCCAG | 2289 | 32279 | FLT1:349U21 sense siNA stab16 | B CUGAGUUUAAAAGGCACCCTT | 2778 |
| 349 | AACUGAGUUUAAAAGGCACCCAG | 2289 | 32280 | FLT1:349U21 sense siNA stab18 | B cuGAGuuuAAAAGGcAcccTT | 2779 |
| 349 | AACUGAGUUUAAAAGGCACCCAG | 2289 | 32281 | FLT1:349U21 sense siNA inv stab16 | B CCCACGGAAAAUUUGAGUCTT | 2780 |
| 349 | AACUGAGUUUAAAAGGCACCCAG | 2289 | 32282 | FLT1:349U21 sense siNA inv stab18 | B cccAcGGAAAAuuuGAGucTT | 2781 |
| 346 | CUGAACUGAGUUUAAAAGGCAC | 2296 | 32283 | FLT1:346U21 sense siNA stab09 | B GAACUGAGUUUAAAAGGCATT | 2782 |
| 347 | UGAACUGAGUUUAAAAGGCACC | 2297 | 32284 | FLT1:347U21 sense siNA stab09 | B AACUGAGUUUAAAAGGCACTT | 2783 |
| 348 | GAACUGAGUUUAAAAGGCACCA | 2298 | 32285 | FLT1:348U21 sense siNA stab09 | B ACUGAGUUUAAAAGGCACCTT | 2784 |
| 350 | ACUGAGUUUAAAAGGCACCCAGC | 2299 | 32286 | FLT1:350U21 sense siNA stab09 | B GAGUUUAAAAGGCACCCAGTT | 2785 |
| 351 | CUGAGUUUAAAAGGCACCCAGCA | 2300 | 32287 | FLT1:351U21 sense siNA stab09 | B AGUUUAAAAGGCACCCAGCTT | 2786 |
| 352 | UGAGUUUAAAAGGCACCCAGCAC | 2301 | 32288 | FLT1:352U21 sense siNA stab09 | B GUUUAAAAGGCACCCAGCATT | 2787 |
| 353 | GAGUUUAAAAGGCACCCAGCACA | 2302 | 32289 | FLT1:353U21 sense siNA stab09 | B UUUAAAAGGCACCCAGCACTT | 2788 |
| 346 | CUGAACUGAGUUUAAAAGGCAC | 2296 | | FLT1.:364L21 antisense siNA (346 C.) stab10 | UGCCUUUUAAACUCAGUCTsT | |
| 347 | UGAACUGAGUUUAAAAGGCACC | 2297 | 32290 | FLT1:365L21 antisense siNA (347 C.) stab10 | GUGCCUUUUAAACUCAGUTsT | 2789 |
| 348 | GAACUGAGUUUAAAAGGCACCA | 2298 | 32291 | FLT1:366L21 antisense siNA (348 C.) stab10 | GGUGCCUUUUAAACUCAGTsT | 2790 |
| 350 | ACUGAGUUUAAAAGGCACCCAGC | 2299 | 32292 | FLT1:368L21 antisense siNA (350 C.) stab10 | UGGGUGCCUUUUAAACUCATsT | 2791 |
| 351 | CUGAGUUUAAAAGGCACCCAGCA | 2300 | 32293 | FLT1:369L21 antisense siNA (351 C.) stab10 | CUGGGUGCCUUUUAAACUTsT | 2792 |
| 352 | UGAGUUUAAAAGGCACCCAGCAC | 2301 | 32294 | FLT1:370L21 antisense siNA (352 C.) stab10 | GCUGGGUGCCUUUUAAACUTsT | 2793 |
| 353 | GAGUUUAAAAGGCACCCAGCACA | 2302 | 32295 | FLT1:371L21 antisense siNA (353 C.) stab10 | UGCUGGGUGCCUUUUAAACTsT | 2794 |
| 346 | CUGAACUGAGUUUAAAAGGCAC | 2296 | 32296 | FLT1:346U21 sense siNA inv stab09 | B ACGGAAAAUUUGAGUCAAGTT | 2795 |
| 347 | UGAACUGAGUUUAAAAGGCACC | 2297 | 32297 | FLT1:347U21 sense siNA inv stab09 | B CACGGAAAAUUUGAGUCAATT | 2796 |
| 348 | GAACUGAGUUUAAAAGGCACCA | 2298 | 32298 | FLT1:348U21 sense siNA inv stab09 | B CCACGGAAAAUUUGAGUCATT | 2797 |
| 350 | ACUGAGUUUAAAAGGCACCCAGC | 2299 | 32299 | FLT1:350U21 sense siNA inv stab09 | B ACCCACGGAAAAUUUGAGUTT | 2798 |
| 351 | CUGAGUUUAAAAGGCACCCAGCA | 2300 | 32300 | FLT1:351U21 sense siNA inv stab09 | B GACCCACGGAAAAUUUGAGTT | 2799 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 352 | UGAGUUUAAAAGGCACCCAGCAC | 2301 | 32301 | FLT1:352U21 sense siNA inv stab09 | B CGACCCACGGAAAAUUUGAUU | 2800 |
| 353 | GAGUUUAAAAGGCACCCAGCACA | 2302 | 32302 | FLT1:353U21 sense siNA inv stab09 | B ACGACCCACGGAAAAUUUGUU | 2801 |
| 346 | CUGAACUGAGUUUAAAAGGCACC | 2296 | 32303 | FLT1:364L21 antisense siNA (346 C.) inv stab10 | CUUGACUCUCAAAUUUUCCGUTsT | 2802 |
| 347 | UGAACUGAGUUUAAAAGGCACCC | 2297 | 32304 | FLT1:365L21 antisense siNA (347 C.) inv stab10 | UUGACUCUCAAAUUUUCCGUGTsT | 2803 |
| 348 | GAACUGAGUUUAAAAGGCACCCA | 2298 | 32305 | FLT1:366L21 antisense siNA (348 C.) inv stab10 | UGACUCUCAAAUUUUCCGUGGTsT | 2804 |
| 350 | ACUGAGUUUAAAAGGCACCCAGC | 2299 | 32306 | FLT1:368L21 antisense siNA (350 C.) inv stab10 | ACUCAAAUUUUCCGUGGGUTsT | 2805 |
| 351 | CUGAGUUUAAAAGGCACCCAGCA | 2300 | 32307 | FLT1:369L21 antisense siNA (351 C.) inv stab10 | CUCAAAUUUUCCGUGGGUCTsT | 2806 |
| 352 | UGAGUUUAAAAGGCACCCAGCAC | 2301 | 32308 | FLT1:370L21 antisense siNA (352 C.) inv stab10 | UCAAAUUUUCCGUGGGUCGTsT | 2807 |
| 353 | GAGUUUAAAAGGCACCCAGCACA | 2302 | 32309 | FLT1:371L21 antisense siNA (353 C.) inv stab10 | CAAAUUUUCCGUGGGUCUTsT | 2808 |
| 349 | AACUGAGUUUAAAAGGCACCCAG | 2289 | 32338 | FLT1:367L21 antisense siNA (349 C.) inv stab10 3'-BrdU | GGGUGCCUUUUAAACUCAGXsT | 2809 |
| 349 | AACUGAGUUUAAAAGGCACCCAG | 2289 | 32718 | FLT1:367L21 antisense siNA (349 C.) v1 5'p | pGGGUGCCUUUUAAACUC GAGUUAAAAG B | 2810 |
| 349 | AACUGAGUUUAAAAGGCACCCAG | 2289 | 32719 | FLT1:367L21 antisense siNA (349 C.) v2 5'p | pGGGUGCCUUUUAAACUCAG GAGUUAAAAG B | 2811 |
| 2967 | AAGCAAGGAGGGCCUCUGAUGGU | 2290 | 32720 | FLT1:2967L21 antisense siNA (2949 C.) v1 5'p | pCAUCAGAGGGCCCUCUGC AAGGAGGGCCUCUU B | 2812 |
| 2967 | AAGCAAGGAGGGCCUCUGAUGGU | 2290 | 32721 | FLT1:2967L21 antisense siNA (2949 C.) v2 5'p | pCAUCAGAGGCCCUCCUU AAGGAGGGCCUCUG B | 2813 |
| 2967 | AAGCAAGGAGGGCCUCUGAUGGU | 2290 | 32722 | FLT1:2967L21 antisense siNA (2949 C.) v3 5'p | pCAUCAGAGGGCCUCCU AGGAGGGCCUCUG B | 2814 |
| 346 | CUGAACUGAGUUUAAAAGGCACC | 2296 | 32748 | FLT1:346U21 sense siNA stab07 | B GAAcuGAGuuuAAAAGGcATT | 2815 |
| 347 | UGAACUGAGUUUAAAAGGCACCC | 2297 | 32749 | FLT1:347U21 sense siNA stab07 | B AAcuGAGuuuAAAAGGcAcTT | 2816 |
| 348 | GAACUGAGUUUAAAAGGCACCCA | 2298 | 32750 | FLT1:348U21 sense siNA stab07 | B AcuGAGuuuAAAAGGcAccTT | 2817 |
| 350 | ACUGAGUUUAAAAGGCACCCAGC | 2299 | 32751 | FLT1:350U21 sense siNA stab07 | B uGAGuuuAAAAGGcAcccATT | 2818 |
| 351 | CUGAGUUUAAAAGGCACCCAGCA | 2300 | 32752 | FLT1:351U21 sense siNA stab07 | B GAGuuuAAAAGGcAcccAGTT | 2819 |
| 352 | UGAGUUUAAAAGGCACCCAGCAC | 2301 | 32753 | FLT1:352U21 sense siNA stab07 | B AGuuuAAAAGGcAcccAGcTT | 2820 |
| 353 | GAGUUUAAAAGGCACCCAGCACA | 2302 | 32754 | FLT1:353U21 sense siNA stab07 | B GuuuAAAAGGcAcccAGcATT | 2821 |
| 346 | CUGAACUGAGUUUAAAAGGCACC | 2296 | 32755 | FLT1:364L21 antisense siNA (346 C.) stab08 | uGccuuuuAAAcucAGuucTsT | 2822 |
| 347 | UGAACUGAGUUUAAAAGGCACCC | 2297 | 32756 | FLT1:365L21 antisense siNA (347 C.) stab08 | GuGccuuuuAAAcucAGuTsT | 2823 |
| 348 | GAACUGAGUUUAAAAGGCACCCA | 2298 | 32757 | FLT1:366L21 antisense siNA (348 C.) stab08 | GGuGccuuuuAAAcucAGuTsT | 2824 |
| 350 | ACUGAGUUUAAAAGGCACCCAGC | 2299 | 32758 | FLT1:368L21 antisense siNA (350 C.) stab08 | uGGGuGccuuuuAAAcucATsT | 2825 |
| 351 | CUGAGUUUAAAAGGCACCCAGCA | 2300 | 32759 | FLT1:369L21 antisense siNA (351 C.) stab08 | cuGGGuGccuuuuAAAcucTsT | 2826 |
| 352 | UGAGUUUAAAAGGCACCCAGCAC | 2301 | 32760 | FLT1:370L21 antisense siNA (352 C.) stab08 | GcuGGGuGccuuuuAAAcuTsT | 2827 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 353 | GAGUUUAAAAGGCACCCAGCACA | 2302 | 32761 | FLT1:371L21 antisense siNA (353 C.) stab08 | uGCuGGGuGccuuuuAAAcTsT | 2828 |
| 346 | CUGAACUGAGUUUAAAAGGCACC | 2296 | 32772 | FLT1:346U21 sense siNA inv stab07 | B AcGGAAAAuuuGAGucAAGTT | 2829 |
| 347 | UGAACUGAGUUUAAAAGGCACCC | 2297 | 32773 | FLT1:347U21 sense siNA inv stab07 | B CAcGGAAAAuuuGAGucAATT | 2830 |
| 348 | GAACUGAGUUUAAAAGGCACCCA | 2298 | 32774 | FLT1:348U21 sense siNA inv stab07 | B ccAcGGAAAAuuuGAGucATT | 2831 |
| 349 | ACUGAGUUUAAAAGGCACCCAGC | 2299 | 32775 | FLT1:350U21 sense siNA inv stab07 | B AcccAcGGAAAAuuuGAGuTT | 2832 |
| 350 | CUGAGUUUAAAAGGCACCCAGCA | 2300 | 32776 | FLT1:351U21 sense siNA inv stab07 | B GAcccAcGGAAAAuuuGAGTT | 2833 |
| 351 | UGAGUUUAAAAGGCACCCAGCAC | 2301 | 32777 | FLT1:352U21 sense siNA inv stab07 | B cGAcccAcGGAAAAuuuGATT | 2834 |
| 352 | GAGUUUAAAAGGCACCCAGCACA | 2302 | 32778 | FLT1:353U21 sense siNA inv stab07 | B AcGAcccAcGGAAAAuuuGTT | 2835 |
| 353 | CUGAACUGAGUUUAAAAGGCACC | 2296 | 32779 | FLT1:364L21 antisense siNA (346 C.) inv stab08 | cuuGAcucAAAuuuuccGuTsT | 2836 |
| 347 | UGAACUGAGUUUAAAAGGCACCC | 2297 | 32780 | FLT1:365L21 antisense siNA (347 C.) inv stab08 | uuGAcucAAAuuuuccGuGTsT | 2837 |
| 348 | GAACUGAGUUUAAAAGGCACCCA | 2298 | 32781 | FLT1:366L21 antisense siNA (348 C.) inv stab08 | uGAcucAAAuuuuccGuGGTsT | 2838 |
| 349 | ACUGAGUUUAAAAGGCACCCAGC | 2299 | 32782 | FLT1:368L21 antisense siNA (350 C.) inv stab08 | AcucAAAuuuuccGuGGGuTsT | 2839 |
| 350 | CUGAGUUUAAAAGGCACCCAGCA | 2300 | 32783 | FLT1:369L21 antisense siNA (351 C.) inv stab08 | cucAAAuuuuccGuGGGucTsT | 2840 |
| 351 | UGAGUUUAAAAGGCACCCAGCAC | 2301 | 32784 | FLT1:370L21 antisense siNA (352 C.) inv stab08 | ucAAAuuuuccGuGGGucGTsT | 2841 |
| 352 | GAGUUUAAAAGGCACCCAGCACA | 2302 | 32785 | FLT1:371L21 antisense siNA (353 C.) inv stab08 | cAAAuuuuccGuGGGucGuTsT | 2842 |
| 353 | AACUGAGUUUAAAAGGCACCCAG | 2289 | 33121 | FLT1:349U21 sense siNA stab22 | CUGAGUUUAAAAGGCACCCUTTB | 2843 |
| 349 | AACUGAGUUUAAAAGGCACCCAG | 2289 | 33321 | FLT1:367L21 antisense siNA (349 C.) stab08 + 5' P | pGGGuGccuuuuAAAcucAGTsT | 2844 |
| 349 | AACUGAGUUUAAAAGGCACCCAG | 2289 | 33338 | FLT1:367L21 antisense siNA (349 C.) stab08 + 5' aminoL | L GGGuGccuuuuAAAcucAGTsT | 2845 |
| 349 | AACUGAGUUUAAAAGGCACCCAG | 2289 | 33553 | FLT1:367L21 antisense siNA (349 C.) stab08 + 5' aminoL | L GGGuGccuuuuAAAcucAGTsT | 2846 |
| 349 | AACUGAGUUUAAAAGGCACCCAG | 2289 | 33571 | FLT1:367L21 antisense siNA (349 C.) stab10 + 5' I | IGGGuGCCUUUUAAACUCAGTT | 2847 |
| 3645 | AUCAUGCUGGACUGCUGGCACAG | 2189 | 33725 | FLT1:3645U21 sense siNA stab07 | B cAuGcuGGAcuGcuGGcAcTT | 2848 |
| 3646 | UCAUGCUGGACUGCUGGCACAGA | 2195 | 33726 | FLT1:3646U21 sense siNA stab07 | B AuGcuGGAcuGcuGGcAcATT | 2849 |
| 3645 | AUCAUGCUGGACUGCUGGCACAG | 2189 | 33731 | FLT1:3663L21 antisense siNA (3645 C.) stab08 | GuGccAGcAGucAGcAuGTsT | 2850 |
| 3646 | UCAUGCUGGACUGCUGGCACAGA | 2195 | 33732 | FLT1:3664L21 antisense siNA (3646 C.) stab08 | uGuGccAGcAGucAGcAuGTsT | 2851 |
| 3645 | AUCAUGCUGGACUGCUGGCACAG | 2189 | 33737 | FLT1:3645U21 sense siNA stab09 | B CAUGCUGGACUGCUGGCACTT | 2852 |
| 3646 | UCAUGCUGGACUGCUGGCACAGA | 2195 | 33738 | FLT1:3646U21 sense siNA stab09 | B AUGCUGGACUGCUGGCACATT | 2853 |
| 3645 | AUCAUGCUGGACUGCUGGCACAG | 2189 | 33743 | FLT1:3663L21 antisense siNA (3645 C.) stab10 | GUGCCAGCAGUCCAGCAUGTsT | 2854 |
| 3646 | UCAUGCUGGACUGCUGGCACAGA | 2195 | 33744 | FLT1:3664L21 antisense siNA (3646 C.) stab10 | UGUGCCAGCAGUCCAGCAUTsT | 2855 |
| 3645 | AUCAUGCUGGACUGCUGGCACAG | 2189 | 33749 | FLT1:3645U21 sense siNA inv stab07 | B cAcGGucGucAGGucGuAcTT | 2856 |
| 3646 | UCAUGCUGGACUGCUGGCACAGA | 2195 | 33750 | FLT1:3646U21 sense siNA inv stab07 | B AcAcGGucGucAGGucGuATT | 2857 |
| 3645 | AUCAUGCUGGACUGCUGGCACAG | 2189 | 33755 | FLT1:3663L21 antisense siNA (3645 C.) inv stab10 | GuAcGAccuGAcGuCGuTsT | 2858 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3646 | UCAUGCUGGACUGCUGGCACAGA | 2195 | 33756 | FLT1:3664L21 antisense siNA (3646 C.) inv stab08 | uAcGAccuGAcGcGuGuTsT | 2859 |
| 3645 | AUCAUGCUGGACUGCUGGCACAG | 2189 | 33761 | FLT1:3645U21 sense siNA inv stab09 | B CACGGUCGUCAGGUCGUACTT | 2860 |
| 3646 | AUCAUGCUGGACUGCUGGCACAG | 2195 | 33762 | FLT1:3646U21 sense siNA inv stab09 | B ACACGGUCGUCAGGUCGUATT | 2861 |
| 3645 | AUCAUGCUGGACUGCUGGCACAG | 2189 | 33767 | FLT1:3663L21 antisense siNA (3645 C.) inv stab10 | GUACGACCUGACGACCGUGTsT | 2862 |
| 3646 | UCAUGCUGGACUGCUGGCACAGA | 2195 | 33768 | FLT1:3664L21 antisense siNA (3646 C.) inv stab10 | UACGACCUGACGACCGUGUTsT | 2863 |
| 349 | AACUGAGUUUAAAAGGCACCCAG | 2289 | 34487 | FLT1:349U21 sense siNA stab09 w/block PS | B CsUsGAGUUUAsAsAsAsGGCAC CsCsTsT B | 2864 |
| 349 | AACUGAGUUUAAAAGGCACCCAG | 2289 | 34488 | FLT1:367L21 antisense siNA (349 C.) stab10 w/block PS | GGGsUsGsCsCsUUUUAsAsAsCsUs CsAGTsT | 2865 |
| 349 | AACUGAGUUUAAAAGGCACCCAG | 2289 | 34489 | FLT1:349U21 sense siNA stab09 inv w/block PS | B CsCsCACGGAsAsAsAsUsUUGAG UsCsTsT B | 2866 |
| 349 | AACUGAGUUUAAAAGGCACCCAG | 2289 | 34490 | FLT1:367L21 antisense siNA (349 C.) stab10 inv w/block PS | GACsUsCsAsAsAUUUUCsCsGsUs GsGGTsT | 2867 |
| 349 | AACUGAGUUUAAAAGGCACCCAG | 2289 | 29694 | FLT1:349U21 sense siNA stab01 | CsUsGsAsGsUUUAAAAGGCACCC TsT | 2868 |
| 2340 | AACAACCACAAAAUACAACAAGA | 2292 | 29695 | FLT1:2340U21 sense siNA stab01 | CsAsAsCsCsACAAAAUACAACAAT sT | 2869 |
| 3912 | AGCCUGGAAAGAGGGCCCUCUGAU | 2291 | 29696 | FLT1:3912U21 sense siNA stab01 | CsCsUsGsGsAAAGAGAAUCAAAAC TsT | 2870 |
| 2949 | AAGCAAGGAGGGCCCUCUGAUGGU | 2290 | 29697 | FLT1:2949U21 sense siNA stab01 | GsCsAsAsGsGAGGGCCCUCUGAU GTsT | 2871 |
| 349 | AACUGAGUUUAAAAGGCACCCAG | 2289 | 29698 | FLT1:367L21 antisense siNA (349 C.) stab01 | GsGsGsUsGsCCUUUUAAACUCA GTsT | 2872 |
| 2340 | AACAACCACAAAAUACAACAAGA | 2292 | 29699 | FLT1:2358L21 antisense siNA (2340 C.) stab01 | UsUsGsUsUsGUAUUUUGUGGUU GTsT | 2873 |
| 3912 | AGCCUGGAAAGAGGGCCCUCUGAU | 2291 | 29700 | FLT1:3930L21 antisense siNA (3912 C.) stab01 | GsGsUsUsUsUGAUUCUUUCCAG GTsT | 2874 |
| 2949 | AAGCAAGGAGGGCCCUCUGAUGGU | 2290 | 29701 | FLT1:2967L21 antisense siNA (2949 C.) stab01 | CsAsUsCsAsGAGGGCCCUCCUG CTsT | 2875 |
| 349 | AACUGAGUUUAAAAGGCACCCAG | 2289 | 29702 | FLT1:349U21 sense siNA stab03 | csusGsAsGuuuAAAAGGCAcscsc sTsT | 2876 |
| 2340 | AACACCACAAAAUACAACAAGA | 2292 | 29703 | FLT1:2340U21 sense siNA stab03 | csAsAscscAcAAAAUaCAcAsAsTsT | 2877 |
| 3912 | AGCCUGGAAAGAGGGCCCUCUGAU | 2291 | 29704 | FLT1:3912U21 sense siNA stab03 | cscsusGsGAAAGAAUcAAAAcscs sT | 2878 |
| 2949 | AAGCAAGGAGGGCCCUCUGAUGGU | 2290 | 29705 | FLT1:2949U21 sense siNA stab03 | GscsAsAsGsAGGGccucuGAsusGs TsT | 2879 |
| 349 | AACUGAGUUUAAAAGGCACCCAG | 2289 | 29706 | FLT1:367L21 antisense siNA (349 C.) stab02 | GsGsGsUsGsCsCsUsUsUsUsAsAs AsCsUsCAsGsTsT | 2880 |
| 2340 | AACACCACAAAAUACAACAAGA | 2292 | 29707 | FLT1:2358L21 antisense siNA (2340 C.) stab02 | UsUsGsUsUsGsUsAsUsUsUsUsGs UsGsGsUsUsGsTsT | 2881 |
| 3912 | AGCCUGGAAAGAGGGCCCUCUGAU | 2291 | 29708 | FLT1:3930L21 antisense siNA (3912 C.) stab02 | GsGsUsUsUsUsGsAsUsUsCsUsUs UsCsCsAsGsGsTsT | 2882 |
| 2949 | AAGCAAGGAGGGCCCUCUGAUGGU | 2290 | 29709 | FLT1:2967L21 antisense siNA (2949 C.) stab02 | CsAsUsCsAsGsAsGsGsCsCsCsUs CsCsUsGsCsTsT | 2883 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2340 | AACAACCACAAAAUACAACAAGA | 2292 | 29981 | FLT1:2340U21 sense siNA Native | CAACCACAAAAUACAACAAGA | 2884 |
| 2340 | AACAACCACAAAAUACAACAAGA | 2292 | 29982 | FLT1:2358L21 antisense siNA Native | UUGUUGUAUUUUGUGGUUGUU | 2885 |
| 2340 | AACAACCACAAAAUACAACAAGA | 2292 | 29983 | FLT1:2340U21 sense siNA stab01 inv FLT1:2358L21 antisense siNA (2340 C.) stab01 inv | AsAsCsAsAsCAUAAAACACCAACTsT GsUsUsGsGsGUGUUUUAUGUUGU UTsT | 2886 2887 |
| 2340 | AACAACCACAAAAUACAACAAGA | 2292 | 29984 | stab01 inv | | |
| 2340 | AACAACCACAAAAUACAACAAGA | 2292 | 29985 | FLT1:2340U21 sense siNA stab03 inv | AsAscsAsAcAUAAAAcAccAsAscsTsT | 2888 |
| 2340 | AACAACCACAAAAUACAACAAGA | 2292 | 29986 | FLT1:2358L21 antisense siNA (2340 C.) stab02 inv | GsUsGsGsUsGsUUUAUGUUGsUsAsUs GsUsGsUsTsT | 2889 |
| 2340 | AACAACCACAAAAUACAACAAGA | 2292 | 29987 | FLT1:2340U21 sense siNA inv Native | AGAACAACAUAAAACACCAAC | 2890 |
| 2340 | AACAACCACAAAAUACAACAAGA | 2292 | 29988 | FLT1:2358L21 antisense siNA (2340 C.) inv Native | UUGUUGGUGUUUUAUGUUGUU | 2891 |
| 2340 | AACAACCACAAAAUACAACAAGA | 2292 | 30075 | FLT1:2340U21 sense siNA | CAACCACAAAAUACAACAATT | 2892 |
| 2340 | AACAACCACAAAAUACAACAAGA | 2292 | 30076 | FLT1:2358L21 antisense siNA | UUGUUGUAUUUUGUGGUUGTT | 2893 |
| 2342 | AACAACCACAAAAUACAACAAGA | 2292 | 30077 | FLT1:2342U21 sense siNA inv | AGAACAACAUAAAACACCATT | 2894 |
| 2340 | AACAACCACAAAAUACAACAAGA | 2292 | 30078 | FLT1:2358L21 antisense siNA (2340 C.) inv | UUGUUGGUGUUUUAUGUUGTT | 2895 |
| 2340 | AACAACCACAAAAUACAACAAGA | 2292 | 30187 | FLT1:2358L21 antisense siNA (2340 C.) 2'- F U, C | uuGuuGuAuuuuGuGGuuGTT | 2896 |
| 2340 | AACAACCACAAAAUACAACAAGA | 2292 | 30190 | FLT1:2358L21 antisense siNA (2340 C.) nitroindole | uuGuuGuAuuuuGuGGuuGXX | 2897 |
| 2340 | AACAACCACAAAAUACAACAAGA | 2292 | 30193 | FLT1:2358L21 antisense siNA (2340 C.) nitropyrole | uuGuuGuAuuuuGuGGuuGZZ | 2898 |
| 2340 | AACAACCACAAAAUACAACAAGA | 2292 | 30196 | FLT1:2340U21 sense siNA stab04 | B cAACCACAAAAuACAcAACAATT | 2899 |
| 2340 | AACAACCACAAAAUACAACAAGA | 2292 | 30199 | FLT1:2340U21 sense siNA sense iB caps | cAAcCAcAAAAuAcAAcAATT | 2900 |
| 2340 | AACAACCACAAAAUACAACAAGA | 2292 | 30340 | FLT1:2358L21 antisense siNA (2340 C.) 3' dT | uuGuuGuAuuuuGuGGuuGTX | 2901 |
| 2340 | AACAACCACAAAAUACAACAAGA | 2292 | 30341 | FLT1:2358L21 antisense siNA (2340 C.) glyceryl | uuGuuGuAuuuuGuGGuuGTG1y | 2902 |
| 2340 | AACAACCACAAAAUACAACAAGA | 2292 | 30342 | FLT1:2358L21 antisense siNA (2340 C.) 3'OMeU | uuGuuGuAuuuuGuGGuuGTU | 2903 |
| 2340 | AACAACCACAAAAUACAACAAGA | 2292 | 30343 | FLT1:2358L21 antisense siNA (234C C.) L-dT | uuGuuGuAuuuuGuGGuuGTt | 2904 |
| 2340 | AACAACCACAAAAUACAACAAGA | 2292 | 30344 | FLT1:2358L21 antisense siNA (2340 C.) L-rU | uuGuuGuAuuuuGuGGuuGTu | 2905 |
| 2340 | AACAACCACAAAAUACAACAAGA | 2292 | 30345 | FLT1:2358L21 antisense siNA (2340 C.) idT | uuGuuGuAuuuuGuGGuuGTD | 2906 |
| 2340 | AACAACCACAAAAUACAACAAGA | 2292 | 30346 | FLT1:2358L21 antisense siNA (2340 C.) 3'dT | uuGuuGuAuuuuGuGGuuGXT | 2907 |
| 2340 | AACAACCACAAAAUACAACAAGA | 2292 | 30416 | FLT1:2358L21 antisense siNA (2340 C.) stab05 | uuGuuGuAuuuuGuGGuuGTsT | 2908 |
| 1184 | UCGUGUAAGGAGUGGACCAUCAU | 2303 | 30777 | FLT1:1184U21 sense siNA stab04 | B GuGuAAGGAGuGGAccAucTT | 2909 |
| 3503 | UUACGGAGUAUUGCUGUGGGAAA | 2304 | 30778 | FLT1:3503U21 sense siNA stab04 | B AcGGAGuAuuGcuGuGGGATT | 2910 |
| 4715 | UAGCAGGCCUAAGACAUGUGAGG | 2305 | 30779 | FLT1:4715U21 sense siNA stab04 | B GcAGGccuAAGAcAuGuGATT | 2911 |
| 4753 | AGCAAAAGCAAGGGAGAAAAGA | 2306 | 30780 | FLT1:4753U21 sense siNA stab04 | B cAAAAGcAAGGGAGAAAATT | 2912 |
| 1184 | UCGUGUAAGGAGUGGACCAUCAU | 2303 | 30781 | FLT1:1202L21 antisense siNA (1184 C.) stab05 | GAuGGuccAcucuuAcAcTsT | 2913 |
| 3503 | UUACGGAGUAUUGCUGUGGGAAA | 2304 | 30782 | FLT1:3521L21 antisense siNA (3503 C.) | ucccAcAGcAAUcucccGuTsT | 2914 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 4715 | UAGCAGGCCUAAGACAUGUGAGG | 2305 | 30783 | FLT1:4733L21 antisense siNA (4715 C.) stab05 | ucAcAUGucuuAGGccuGcTsT | 2915 |
| 4753 | AGCAAAAAGCAAGGGAGAAAAGA | 2306 | 30784 | FLT1:4771L21 antisense siNA (4753 C.) stab05 | uuuucucccuuGcuuuuuGTsT | 2916 |
| 2340 | AACACCACAAAAUACAACAAGA | 2292 | 30955 | FLT1:2340U21 sense siNA stab07 | B cAAccAcAAAAuAcAAcAATT | 2917 |
| 2340 | AACACCACAAAAUACAACAAGA | 2292 | 30956 | FLT1:2358L21 antisense siNA (2340 C.) stab08 | uGuuGuAuuuuGGGuuGTsT | 2918 |
| 2340 | AACACCACAAAAUACAACAAGA | 2292 | 30963 | FLT1:2340U21 sense siNA inv | AACAACAUAAAAACACCACTT | 2919 |
| 2340 | AACACCACAAAAUACAACAAGA | 2292 | 30964 | FLT1:2358L21 antisense siNA (2340 C.) inv | GUUGUGUUUUAUGUUGUUTT | 2920 |
| 2340 | AACACCACAAAAUACAACAAGA | 2292 | 30965 | FLT1:2340U21 sense siNA stab04 inv | B AACAACAuAAAAAcAccAAcTT | 2921 |
| 2340 | AACACCACAAAAUACAACAAGA | 2292 | 30966 | FLT1:2358L21 antisense siNA (2340 C.) stab05 inv | GuuGGuGuuuuAuGuuGuuTsT | 2922 |
| 2340 | AACACCACAAAAUACAACAAGA | 2292 | 30967 | FLT1:2340U21 sense siNA stab07 inv | B AAcAAcAuAAAAAcAccAAcTT | 2923 |
| 2340 | AACACCACAAAAUACAACAAGA | 2292 | 30968 | FLT1:2358L21 antisense siNA (2340 C.) stab08 inv | GuuGGuGuuuuAuGuuGuuTsT | 2924 |
| 349 | AACUGAGUUUAAAAGGCACCCAG | 2289 | 31182 | FLT1:349U21 sense siNA stab00 | CUGAGUUUAAAAGGCACCCTT | 2925 |
| 2949 | AAGCAAGGAGGGCCUCUGAUGGU | 2290 | 31183 | FLT1:2949U21 sense siNA TT | GCAAGGAGGGCCUCUGAUGTT | 2926 |
| 3912 | AGCCUGGAAAGAAUCAAAACCUU | 2291 | 31184 | FLT1:3912U21 sense siNA TT | CCUGGAAAGAAUCAAAACCTT | 2927 |
| 349 | AACUGAGUUUAAAAGGCACCCAG | 2289 | 31185 | FLT1:367L21 antisense siNA (349 C.) stab00 | GGGUGCCUUUUAAACUCAGTT | 2928 |
| 2949 | AAGCAAGGAGGGCCUCUGAUGGU | 2290 | 31186 | FLT1:2967L21 antisense siNA (2949 C.) TT | CAUCAGAGGCCCUCCUUGCTT | 2929 |
| 3912 | AGCCUGGAAAGAAUCAAAACCUU | 2291 | 31187 | FLT1:3930L21 antisense siNA (3912 C.) TT | GGUUUUGAUUCUUUCCAGGTT | 2930 |
| 349 | AACUGAGUUUAAAAGGCACCCAG | 2289 | 31188 | FLT1:349U21 sense siNA stab04 | B cuGAGuuuAAAAGGcAcccTT | 2931 |
| 2949 | AAGCAAGGAGGGCCUCUGAUGGU | 2290 | 31189 | FLT1:2949U21 sense siNA stab04 | B GcAAGGAGGGccucuGAuGTT | 2932 |
| 3912 | AGCCUGGAAAGAAUCAAAACCUU | 2291 | 31190 | FLT1:3912U21 sense siNA stab04 | B ccuGGAAAGAAucAAAAccTT | 2933 |
| 349 | AACUGAGUUUAAAAGGCACCCAG | 2289 | 31191 | FLT1:367L21 antisense siNA (349 C.) stab04 | B GGGucccuuuuAAAcucAGTsT | 2934 |
| 2949 | AAGCAAGGAGGGCCUCUGAUGGU | 2290 | 31192 | FLT1:2967L21 antisense siNA (2949 C.) stab05 | cAucAGAGGccccccuuGcTsT | 2935 |
| 3912 | AGCCUGGAAAGAAUCAAAACCUU | 2291 | 31193 | FLT1:3930L21 antisense siNA (3912 C.) stab05 | GGuuuuGAuucuuuccAGGTsT | 2936 |
| 349 | AACUGAGUUUAAAAGGCACCCAG | 2289 | 31194 | FLT1:349U21 sense siNA stab07 | B cuGAGuuuAAAAGGcAcccTT | 2937 |
| 2949 | AAGCAAGGAGGGCCUCUGAUGGU | 2290 | 31195 | FLT1:2949U21 sense siNA stab07 | B GcAAGGAGGGccucuGAuGTT | 2938 |
| 3912 | AGCCUGGAAAGAAUCAAAACCUU | 2291 | 31196 | FLT1:3912U21 sense siNA stab07 | B ccuGGAAAGAAucAAAAccTT | 2939 |
| 349 | AACUGAGUUUAAAAGGCACCCAG | 2289 | 31197 | FLT1:367L21 antisense siNA (349 C.) stab08 | B GGGuGccuuuuAAAcucAGTsT | 2940 |
| 2949 | AAGCAAGGAGGGCCUCUGAUGGU | 2290 | 31198 | FLT1:2967L21 antisense siNA (2949 C.) stab05 | cAucAGAGGccccccuuGcTsT | 2941 |
| 3912 | AGCCUGGAAAGAAUCAAAACCUU | 2291 | 31199 | FLT1:3930L21 antisense siNA (3912 C.) stab08 | GGuuuuGAuucuuuccAGGTsT | 2942 |
| 349 | AACUGAGUUUAAAAGGCACCCAG | 2289 | 31200 | FLT1:349U21 sense siNA inv TT | CCCACGCGAAAAUUUGAGUCTT | 2943 |
| 2949 | AAGCAAGGAGGGCCUCUGAUGGU | 2290 | 31201 | FLT1:2949U21 sense siNA inv TT | GUAGUCUCCGGAGGAACGTT | 2944 |
| 3912 | AGCCUGGAAAGAAUCAAAACCUU | 2291 | 31202 | FLT1:3912U21 sense siNA inv TT | CCAAACUAAGAAAGGUCCTT | 2945 |
| 349 | AACUGAGUUUAAAAGGCACCCAG | 2289 | 31203 | FLT1:367L21 antisense siNA (349 C.) inv TT | GACUCAAAUUUUCCGUGGGTT | 2946 |
| 2949 | AAGCAAGGAGGGCCUCUGAUGGU | 2290 | 31204 | FLT1:2967L21 antisense siNA (2949 C.) inv | CGUUCUCCCGGAGACUACTT | 2947 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3912 | AGCCUGGAAAGAAUCAAAACCUU | 2291 | 31205 | FLT1:3930L21 antisense siNA (3912 C.) inv TT | GGACCUUUCUUAGUUUUGGTT | 2948 |
| 349 | AACUGAGUUUAAAAGGCACCCAG | 2289 | 31206 | FLT1:349U21 sense siNA stab04 inv TT | B cccAcGGAAAAAuuuGAGucTT | 2949 |
| 2949 | AAGCAAGGAGGGCCUCUGAUGGU | 2290 | 31207 | FLT1:2949U21 sense siNA stab04 inv | B GuAGucccGGGAGGAAcGTT | 2950 |
| 3912 | AGCCUGGAAAGAAUCAAAACCUU | 2291 | 31208 | FLT1:3912U21 sense siNA stab04 inv | B ccAAAAcuAAGAAAGGuccTT | 2951 |
| 2949 | AAGCAAGGAGGGCCUCUGAUGGU | 2290 | 31510 | FLT1:2967L21 antisense siNA (2949 C.) stab11 | cAucAGAGGccuccuuGcTsT | 2952 |
| 349 | AACUGAGUUUAAAAGGCACCCAG | 2289 | 31511 | FLT1:367L21 antisense siNA (349 C.) stab11 | GGGuGccuuuuAAAcucAGTsT | 2953 |
| 3912 | AGCCUGGAAAGAAUCAAAACCUU | 2291 | 31512 | FLT1:3930L21 antisense siNA (3912 C.) stab11 | GGuuuGAuucuuuccAGGTsT | 2954 |
| 2340 | AACAACCACAAAAUACAACAAGA | 2292 | 31513 | FLT1:2358L21 antisense siNA (2340 C.) stab11 | GuuGGuGuuuuAuGuuGuuTsT | 2955 |
| 2949 | AAGCAAGGAGGGCCUCUGAUGGU | 2290 | 31514 | FLT1:2967L21 antisense siNA (2949 C.) inv stab11 | cGuccucccGGAGAcuAcTsT | 2956 |
| 349 | AACUGAGUUUAAAAGGCACCCAG | 2289 | 31515 | FLT1:367L21 antisense siNA (349 C.) inv stab11 | GAcucAAAuuuccGuGGGTsT | 2957 |
| 3912 | AGCCUGGAAAGAAUCAAAACCUU | 2291 | 31516 | FLT1:3930L21 antisense siNA (3912 C.) inv stab11 | GGAccuuucuuAGuuuuGGTsT | 2958 |
| 349 | AACUGAGUUUAAAAGGCACCCAG | 2289 | 34426 | 5' n-1 C31270 FLT1:349U21 sense siNA stab09 | CUGAGUUUAAAAGGCACCCTT B | 2843 |
| 349 | AACUGAGUUUAAAAGGCACCCAG | 2289 | 34427 | 5' n-2 C31270 FLT1:349U21 sense siNA stab09 | UGAGUUUAAAAGGCACCCTT B | 2959 |
| 349 | AACUGAGUUUAAAAGGCACCCAG | 2289 | 34428 | 5' n-3 C31270 FLT1:349U21 sense siNA stab09 | GAGUUUAAAAGGCACCCTT B | 2960 |
| 349 | AACUGAGUUUAAAAGGCACCCAG | 2289 | 34429 | 5' n-4 C31270 FLT1:349U21 sense siNA stab09 | AGUUUAAAAGGCACCCTT B | 2961 |
| 349 | AACUGAGUUUAAAAGGCACCCAG | 2289 | 34430 | 5' n-5 C31270 FLT1:349U21 sense siNA stab09 | GUUUAAAAGGCACCCTT B | 2962 |
| 349 | AACUGAGUUUAAAAGGCACCCAG | 2289 | 34431 | 5' n-7 C31270 FLT1:349U21 sense siNA stab09 | UUAAAAGGCACCCTT B | 2963 |
| 349 | AACUGAGUUUAAAAGGCACCCAG | 2289 | 34432 | 5' n-9 C31270 FLT1:349U21 sense siNA stab09 | AAAAGGCACCCTT B | 2964 |
| 349 | AACUGAGUUUAAAAGGCACCCAG | 2289 | 34433 | 3' n-1 C31270 FLT1:349U21 sense siNA stab09 | B CUGAGUUUAAAAGGCACCCTT | 2965 |
| 349 | AACUGAGUUUAAAAGGCACCCAG | 2289 | 34434 | 3' n-2 C31270 FLT1:349U21 sense siNA stab09 | B CUGAGUUUAAAAGGCACCCT | 2966 |
| 349 | AACUGAGUUUAAAAGGCACCCAG | 2289 | 34435 | 3' n-3 C31270 FLT1:349U21 sense siNA stab09 |  | 2967 |
| 349 | AACUGAGUUUAAAAGGCACCCAG | 2289 | 34436 | 3' n-4 C31270 FLT1:349U21 sense siNA stab09 | B CUGAGUUUAAAAGGCACCC | 2968 |
| 349 | AACUGAGUUUAAAAGGCACCCAG | 2289 | 34437 | 3' n-5 C31270 FLT1:349U21 sense siNA stab09 | B CUGAGUUUAAAAGGCACC | 2969 |
| 349 | AACUGAGUUUAAAAGGCACCCAG | 2289 | 34438 | 3' n-7 C31270 FLT1:349U21 sense siNA stab09 | B CUGAGUUUAAAAGGCAC | 2970 |
| 349 | AACUGAGUUUAAAAGGCACCCAG | 2289 | 34439 | 5' n-1 C31273 FLT1:367L21 antisense | GGUGCCUUUUAAACUCAGTsT | 2971 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 349 | AACUGAGUUUAAAAGGCACCCAG | 2289 | 34440 | siNA (349 C.) stab10 | GUGCCUUUUAAACUCAGTsT | 2972 |
| 349 | AACUGAGUUUAAAAGGCACCCAG | 2289 | 34441 | 5' n-2 C31273 FLT1:367L21 antisense siNA (349 C.) stab10 | UGCCUUUUAAACUCAGTsT | 2973 |
| 349 | AACUGAGUUUAAAAGGCACCCAG | 2289 | 34442 | 5' n-3 C31273 FLT1:367L21 antisense siNA (349 C.) stab10 | GCCUUUUAAACUCAGTsT | 2974 |
| 349 | AACUGAGUUUAAAAGGCACCCAG | 2289 | 34443 | 5' n-4 C31273 FLT1:367L21 antisense siNA (349 C.) stab10 | CCUUUUAAACUCAGTsT | 2975 |
| 349 | AACUGAGUUUAAAAGGCACCCAG | 2289 | 34444 | 5' n-5 C31273 FLT1:367L21 antisense siNA (349 C.) stab10 | GGGUGCCUUUUAAACUCAGT | 2976 |
| 349 | AACUGAGUUUAAAAGGCACCCAG | 2289 | 34445 | 3' n-1 C31273 FLT1:367L21 antisense siNA (349 C.) stab10 | GGGUGCCUUUUAAACUCAG | 2977 |
| 349 | AACUGAGUUUAAAAGGCACCCAG | 2289 | 34446 | 3' n-2 C31273 FLT1:367L21 antisense siNA (349 C.) stab10 | GGGUGCCUUUUAAACUCA | 2978 |
| 349 | AACUGAGUUUAAAAGGCACCCAG | 2289 | 34447 | 3' n-3 031273 FLT1:367L21 antisense siNA (349 C.) stab10 | GGGUGCCUUUUAAACUC | 2979 |
| 349 | AACUGAGUUUAAAAGGCACCCAG | 2289 | 34448 | 3' n-4 C31273 FLT1:367L21 antisense siNA (349 C.) stab10 | GGGUGCCUUUUAAACU | 2980 |
| 349 | AACUGAGUUUAAAAGGCACCCAG | 2289 | 34449 | 3' n-5 C31273 FLT1:367L21 antisense siNA (349 C.) stab10 | GGGUGCCUUUUAAA | 2981 |
| 349 | AACUGAGUUUAAAAGGCACCCAG | 2289 | 34450 | 3' n-7 C31273 FLT1:367L21 antisense siNA (349 C.) stab10 | GGGUGCCUUUUA | 2982 |
| 349 | AACUGAGUUUAAAAGGCACCCAG | 2289 | 34452 | FLT1:367L21 antisense siNA (349 C.) stab10 | CUACCAGCGAGUUUGUAGUUUA AAAAAAAAAAAAAAsA | 2983 |
| 349 | AACUGAGUUUAAAAGGCACCCAG | 2289 | 34453 | scram1 + A15 all 2'OMe | CUACCAGCGAGUUUGUAGUUUA AAAAAAAAAAAAAAAAAAAsA | 2984 |
| 349 | AACUGAGUUUAAAAGGCACCCAG | 2289 | 34454 | scram1 + A20 all 2'OMe | CUACCAGCGAGUUUGUAGUUUA AAAAAAAAAAAAAAAAAAAAAAAAsA | 2985 |
| 349 | AACUGAGUUUAAAAGGCACCCAG | 2289 | 34455 | scram1 + A25 all 2'OMe | CUACCAGCGAGUUUGUAGUUUA AAAAAAAAAAAAAAAAAAAAAAAAAAAAAsA | 2986 |
| 1501 | ACCUCACUGCCACUCUAAUUGUC | 2307 | 34676 | FLT1:1501U21 sense siNA stab00 | CUCACUGCCACUCUAAUUGTT | 2987 |
| 1502 | CCUCACUGCCACUCUAAUUGUCA | 2308 | 34677 | FLT1:1502U21 sense siNA stab00 | UCACUGCCACUCUAAUUGUTT | 2988 |
| 1503 | CUCACUGCCACUCUAAUUGUCAA | 2309 | 34678 | FLT1:1503U21 sense siNA stab00 | CACUGCCACUCUAAUUGUCTT | 2989 |
| 5353 | AAGACCCGUCUCUAUACCAACC | 2310 | 34679 | FLT1:5353U21 sense siNA stab00 | GACCCGUCUCUAUACCAATT | 2990 |
| 1501 | ACCUCACUGCCACUCUAAUUGUC | 2307 | 34684 | FLT1:1519L21 (1501 C.) siRNA stab00 | ACAUUAGAGUGGCAGUGAGTT | 2991 |
| 1502 | CCUCACUGCCACUCUAAUUGUCA | 2308 | 34685 | FLT1:1520L21 (1502 C.) siRNA stab00 | ACAAUUAGAGUGGCAGUGATT | 2992 |
| 1503 | CUCACUGCCACUCUAAUUGUCAA | 2309 | 34686 | FLT1:1521L21 (1503 C.) siRNA stab00 | GACAAUUAGAGUGGCAGUGTT | 2993 |
| 5353 | AAGACCCGUCUCUAUACCAACC | 2310 | 34687 | FLT1:5371L21 (5353 C.) siRNA stab00 | UUGGUAUAGAGACGGGUCTT | 2994 |
| 349 | AACUGAGUUUAAAAGGCACCCAG | 2289 | 35117 | FLT1:349U21 sense siNA stab07 N1 | B cuGAGuuuAAAAGGCACCCTT B | 2995 |
| 349 | AACUGAGUUUAAAAGGCACCCAG | 2289 | 35118 | FLT1:367L21 antisense siNA (349 C.) stab08 N1 | | 2996 |
| 349 | AACUGAGUUUAAAAGGCACCCAG | 2289 | 35119 | FLT1:367L21 antisense siNA (349 C.) stab08 N2 | GGGUGccuuuuAAAcucAGTsT | 2997 |
| 349 | AACUGAGUUUAAAAGGCACCCAG | 2289 | 35120 | FLT1:367L21 antisense siNA (349 C.) stab08 N3 | GGGUGccuuuuAAcucAGTsT | 2998 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 349 | AACUGAGUUUAAAGGCACCCAG | 2289 | 35121 | FLT1:367L21 antisense siNA (349 C.) stab25 | GGGuGccuuuuAAAcucAGTsT | 2999 |
| 349 | AACUGAGUUUAAAGGCACCCAG | 2289 | 35122 | FLT1:367L21 antisense siNA (349 C.) stab08 N5 | GGGuGccuuuuAAAcucAGTsT | 3000 |
| 349 | AACUGAGUUUAAAGGCACCCAG | 2289 | 35123 | FLT1:367L21 antisense siNA (349 C.) stab24 | GGGuGccuuuuAAAcucAGTsT | 3001 |
| 346 | CUGAACUGAGUUUAAAGGCACC | 2296 | 35814 | FLT1:346U21 sense siNA stab23 | B GAAcuGAGuuuAAAAGGcATT | 3002 |
| 346 | CUGAACUGAGUUUAAAGGCACC | 2296 | 35815 | FLT1:346U21 sense siNA stab07 N2 | B GAAcuGAGuuuAAAAGGCATT | 3003 |
| 346 | CUGAACUGAGUUUAAAGGCACC | 2296 | 35816 | FLT1:364L21 antisense siNA (346 C.) stab24 | UGCcuuuuAAAcucAGuucTsT | 3004 |
| 346 | CUGAACUGAGUUUAAAGGCACC | 2296 | 35817 | FLT1:364L21 antisense siNA (346 C.) stab08 N2 | UGCcuuuuAAAcucAGuucTsT | 3005 |
| 346 | CUGAACUGAGUUUAAAGGCACC | 2296 | 35818 | FLT1:364L21 antisense siNA (346 C.) stab24 | UGCcuuuuAAAcucAGuucTsT | 3006 |
| 346 | CUGAACUGAGUUUAAAGGCACC | 2296 | 35909 | FLT1:346U21 sense siNA stab07 J1 | GAAcuGAGUuAAAAGGcATT | 3007 |
| 346 | CUGAACUGAGUUUAAAGGCACC | 2296 | 35910 | FLT1:364L21 antisense siNA (346 C.) stab08 J1 | UGCcuuuuAAAcucAGUucTsT | 3008 |
| 47 | GAGCGGGCUCCGGGCUCGGUG | 2311 | 36152 | FLT1:47U21 sense siNA stab00 | GCGGGCUCCGGGCUCGGGTT | 3009 |
| 121 | CUGGAGCCGCGAGACGGGC | 2312 | 36153 | FLT1:121U21 sense siNA stab00 | GGCUGGAGCCGCGAGACGGTT | 3010 |
| 122 | UGGCUGGAGCCGCGAGACGGCG | 2313 | 36154 | FLT1:122U21 sense siNA stab00 | GCUGGAGCCGCGAGACGGGTT | 3011 |
| 251 | CAUGGUCAGCUACUGGGACACCG | 2314 | 36155 | FLT1:251U21 sense siNA stab00 | UGGUCAGCUACUGGGACACTT | 3012 |
| 252 | AUGGUCAGCUACUGGGACACCU | 2315 | 36156 | FLT1:252U21 sense siNA stab00 | GGUCAGCUACUGGGACACUTT | 3013 |
| 354 | AGUUUAAAGGCACCCAGCACAU | 2316 | 36157 | FLT1:354U21 sense siNA stab00 | UUUAAAGGCACCCAGCACUTT | 3014 |
| 419 | AGCAGCCCAUAAAGGCUUUGC | 2317 | 36158 | FLT1:419U21 sense siNA stab00 | CAGCCCAUAAAUGGCUUUTT | 3015 |
| 594 | UCAAAGAAGGAAACAGAAUCU | 2318 | 36159 | FLT1:594U21 sense siNA stab00 | AAAGAAGGAAACAGAATT | 3016 |
| 595 | CAAAGAAGGAAACAGAAUCU | 2319 | 36160 | FLT1:595U21 sense siNA stab00 | AAGAAGGAAACAGAAUTT | 3017 |
| 709 | AGCUCGUCAUCCCCUGCCGGGU | 2320 | 36161 | FLT1:709U21 sense siNA stab00 | CUCGUCAUCCCCUGCCGGGTT | 3018 |
| 710 | GCUCGUCAUCCCCUGCCGGGUA | 2321 | 36162 | FLT1:710U21 sense siNA stab00 | UCGUCAUCCCCUGCCGGUTT | 3019 |
| 758 | AAAAAGUUCCACUUGACACUU | 2322 | 36163 | FLT1:758U21 sense siNA stab00 | AAAAGUUCCACUUGACACTT | 3020 |
| 759 | AAAAGUUCCACUUGACACUUU | 2323 | 36164 | FLT1:759U21 sense siNA stab00 | AAAGUUCCACUUGACACUTT | 3021 |
| 796 | AACCAUAAUCUGGGACAGUAGA | 2324 | 36165 | FLT1:796U21 sense siNA stab00 | CGAUAAUCUGGGACAGUATT | 3022 |
| 797 | ACGCAUAAUCUGGGACAGUAGAA | 2325 | 36166 | FLT1:797U21 sense siNA stab00 | GCAUAAUCUGGGACAGUAGTT | 3023 |
| 798 | CGCAUAAUCUGGGACAGUAGAA | 2326 | 36167 | FLT1:798U21 sense siNA stab00 | CAUAAUCUGGGACAGUAGATT | 3024 |
| 799 | GCAUAAUCUGGGACAGUAGAAG | 2327 | 36168 | FLT1:799U21 sense siNA stab00 | AUAAUCUGGGACAGUAGATT | 3025 |
| 1220 | CACCUCAGUGCAUAUAUAUGAUA | 2328 | 36169 | FLT1:1220U21 sense siNA stab00 | CCUCAGUGCAUAUAUAUGATT | 3026 |
| 1438 | CUGAAGAGGAUGCAGGGAAUAU | 2329 | 36170 | FLT1:1438U21 sense siNA stab00 | GAAGAGGAUGCAGGGAAUUTT | 3027 |
| 1541 | UUACGAAAAGGCCGUGUCACGU | 2330 | 36171 | FLT1:1541U21 sense siNA stab00 | ACGAAAAGGCCGUGUCACUTT | 3028 |
| 1640 | AUCAAGUGGUUCUGGACACCCU | 2331 | 36172 | FLT1:1640U21 sense siNA stab00 | UCAAGUGGUUCUGGACACCTT | 3029 |
| 1666 | ACCAUCAUUCCGAAGCAAGG | 2332 | 36173 | FLT1:1666U21 sense siNA stab00 | CAUCAUUCCGAAGCAATT | 3030 |
| 1877 | GACUGUGGAAGAUCAAACUAAGCU | 2333 | 36174 | FLT1:1877U21 sense siNA stab00 | CUGUGGAAGAUCAAACAAGTT | 3031 |
| 2247 | ACCUCAGUGAUCACACAGUGGCC | 2334 | 36175 | FLT1:2247U21 sense siNA stab00 | CCUCAGUGAUCACACAGUGTT | 3032 |
| 2248 | CCUCAGUGAUCACACAGUGGCC | 2335 | 36176 | FLT1:2248U21 sense siNA stab00 | CUCAGUGAUCACACAGUGGTT | 3033 |
| 2360 | AGAGCCUGGAAUAUUUUAGGAC | 2336 | 36177 | FLT1:2360U21 sense siNA stab00 | AGCCUGGAAUAUUUUAGGTT | 3034 |
| 2415 | ACAGAAGAGGAUGAAGGUGUCUA | 2337 | 36178 | FLT1:2415U21 sense siNA stab00 | AGAAGAGGAUGAAGGUGUCTT | 3035 |
| 2514 | UCUAAUCUGGAGCUGAUCACUCU | 2338 | 36179 | FLT1:2514U21 sense siNA stab00 | UAAUCUGGAGCUGAUCACUTT | 3036 |
| 2518 | AUCUGGAGCUGAUCACUCUAACA | 2339 | 36180 | FLT1:2518U21 sense siNA stab00 | CUGGAGCUGAUCACUCUAATT | 3037 |
| 2703 | AGCAAGUGGAGUUGCCCGGGA | 2340 | 36181 | FLT1:2703U21 sense siNA stab00 | CAAGUGGAGUUGCCCGGTT | 3038 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2795 | CAUUAAGAAAUCACCUACGUGCC | 2341 | 36182 | FLT1:2795U21 sense siNA stab00 | UUAAGAAAUCACCUACGUGUU | 3039 |
| 2965 | UGAUGGUGAUUGAAUACUGC | 2342 | 36183 | FLT1:2965U21 sense siNA stab00 | AUGGUGAUUGAAUGGAGCCAGUU | 3040 |
| 3074 | GAAAGAAAAAUGGAGCCAGGCC | 2343 | 36184 | FLT1:3074U21 sense siNA stab00 | AAGAAAAAUGGAGCCAGGUU | 3041 |
| 3100 | AACAAGGCAAGAAACCAAGACUA | 2344 | 36185 | FLT1:3100U21 sense siNA stab00 | CAAGGCAAGAAACCAAGACUU | 3042 |
| 3101 | ACAAGGCAAGAAACCAAGACUAG | 2345 | 36186 | FLT1:3101U21 sense siNA stab00 | AAGGCAAGAAACCAAGACUU | 3043 |
| 3182 | GAGUGAUGUUGAGGAAGAGGAGG | 2346 | 36187 | FLT1:3182U21 sense siNA stab00 | GUGAUGUUGAGGAAGAGGAUU | 3044 |
| 3183 | AGUGAUGUUGAGGAAGAGGAGGA | 2347 | 36188 | FLT1:3183U21 sense siNA stab00 | UGAUGUUGAGGAAGAGGAGUU | 3045 |
| 3253 | CUUACAGUUUUCAAGUGGCCAGA | 2348 | 36189 | FLT1:3253U21 sense siNA stab00 | UACAGUUUUCAAGUGGCCAUU | 3046 |
| 3254 | UUACAGUUUUCAAGUGGCCAGAG | 2349 | 36190 | FLT1:3254U21 sense siNA stab00 | ACAGUUUUCAAGUGGCCAGUU | 3047 |
| 3260 | UUUCAAGUGGCCAGAGGCAUGG | 2350 | 36191 | FLT1:3260U21 sense siNA stab00 | UUCAAGUGGCCAGAGGCAUUU | 3048 |
| 3261 | UUUCAAGUGGCCAGAGGCAUGGA | 2351 | 36192 | FLT1:3261U21 sense siNA stab00 | UCAAGUGGCCAGAGGCAUGUU | 3049 |
| 3294 | UCCAGAAAGUGCAUUCAUCGGGA | 2352 | 36193 | FLT1:3294U21 sense siNA stab00 | CAGAAAGUGCAUUCAUCGGUU | 3050 |
| 3323 | AGCCAGAAACAUUCUUUUAUCUG | 2353 | 36194 | FLT1:3323U21 sense siNA stab00 | CGAGAAACAUUCUUUUAUCUU | 3051 |
| 3324 | GCGAGAAACAUUCUUUUAUCUGA | 2354 | 36195 | FLT1:3324U21 sense siNA stab00 | GAGAAACAUUCUUUUAUCUUU | 3052 |
| 3325 | CGAGAAACAUUCUUUUAUCUGAG | 2355 | 36196 | FLT1:3325U21 sense siNA stab00 | AGAAACAUUCUUUUAUCUGUU | 3053 |
| 3513 | UGCUGUGGGGAAAUCUCUCCUU | 2356 | 36197 | FLT1:3513U21 sense siNA stab00 | GCUGUGGGAAAUCUCUCCUU | 3054 |
| 3812 | CCUUCUCGAGGACUUCUUCA | 2357 | 36198 | FLT1:3812U21 sense siNA stab00 | CCUUCUCGAGGACUUCUUUU | 3055 |
| 3864 | UCAGGAAGCUCUGAUGAUGUCA | 2358 | 36199 | FLT1:3864U21 sense siNA stab00 | AGGAAGCUCUGAUGAUGUCUU | 3056 |
| 3865 | CAGGAAGCUCUGAUGAUGUCAGA | 2359 | 36200 | FLT1:3865U21 sense siNA stab00 | GGAAGCUCUGAUGAUGUCAUU | 3057 |
| 3901 | UCAAGUUCAUGAGCCUGGAAAGA | 2360 | 36201 | FLT1:3901U21 sense siNA stab00 | AAGUUCAUGAGCCUGGAAAUU | 3058 |
| 3902 | CAAGUUCAUGAGCCUGGAAAGAA | 2361 | 36202 | FLT1:3902U21 sense siNA stab00 | AGUUCAUGAGCCUGGAAAGUU | 3059 |
| 3910 | GAGCCUGGAAAGAAUCAAAACC | 2362 | 36203 | FLT1:3910U21 sense siNA stab00 | AGCCUGGAAAGAAUCAAAAUU | 3060 |
| 4136 | CAGCUGUGGCACCUCAGCGAAG | 2363 | 36204 | FLT1:4136U21 sense siNA stab00 | GCUGUGGCACCUCAGCGAUU | 3061 |
| 4154 | CGAAGGCAAGCGCAGGUUCACUU | 2364 | 36205 | FLT1:4154U21 sense siNA stab00 | AAGGCAAGCGCAGGUUCACUU | 3062 |
| 4635 | CAGCCCAAAACCCAGGGCAAC | 2365 | 36206 | FLT1:4635U21 sense siNA stab00 | CAGCCCAAAACCCAGGGCAUU | 3063 |
| 4945 | GAGGCAAGAAAGGACAAAUAUC | 2366 | 36207 | FLT1:4945U21 sense siNA stab00 | GGCAAGAAAGGACAAAUAUU | 3064 |
| 5090 | UUGGCUCCUCUAGUAAGAUGCAC | 2367 | 36208 | FLT1:5090U21 sense siNA stab00 | GGCUCCUCUAGUAAGAUGCUU | 3065 |
| 5137 | GUCUCCAGGCCAUGAUGGCCUUA | 2368 | 36209 | FLT1:5137U21 sense siNA stab00 | CUCCAGGCCAUGAUGGCCUUU | 3066 |
| 5138 | UCUCCAGGCCAUGAUGGCCUUAC | 2369 | 36210 | FLT1:5138U21 sense siNA stab00 | UCCAGGCCAUGAUGGCCUUUU | 3067 |
| 5354 | AGACCCGUCUAUACCAACCA | 2370 | 36211 | FLT1:5354U21 sense siNA stab00 | ACCCGUCUAUACCAACUUU | 3068 |
| 5356 | ACCCGUCUAUACCAACCAAA | 2371 | 36212 | FLT1:5356U21 sense siNA stab00 | CCGUCUAUACCAACCAUUU | 3069 |
| 5357 | CCCGUCUCUAUACCAACCAAAC | 2372 | 36213 | FLT1:5357U21 sense siNA stab00 | CCGUCUCUAUACCAACCAUUU | 3070 |
| 5707 | GAUCAAGUGGGCCUUGGAUCGCU | 2373 | 36214 | FLT1:5707U21 sense siNA stab00 | UCAAGUGGGCCUUGGAUCGUU | 3071 |
| 5708 | AUCAAGUGGGCCUUGGAUCGCUG | 2374 | 36215 | FLT1:5708U21 sense siNA stab00 | CAAGUGGGCCUUGGAUCGCUU | 3072 |
| 47 | GAGCGGGCCUCCGGGCUCCGGUG | 2311 | 36216 | FLT1:65L21 antisense siNA (47 C.) stab00 | CCCGAGCCCCGGAGCCCGCUU | 3073 |
| 121 | CUGGGCUGGAGCCGCGAGACGGG | 2312 | 36217 | FLT1:139L21 antisense siNA (121 C.) stab00 | CCGUCUCGCGGCUCCAGCCUU | 3074 |
| 122 | UGGGCUGGAGCCGCGAGACGGGG | 2313 | 36218 | FLT1:140L21 antisense siNA (122 C.) stab00 | CCCGUCUCGCGGCUCCAGCUU | 3075 |
| 251 | CAUGGUCAGCUACUGGGACACCG | 2314 | 36219 | FLT1:269L21 antisense siNA (251 C.) stab00 | GUGUCCCAGUAGCUGACCUU | 3076 |
| 252 | AUGGUCAGCUACUGGGACACCGG | 2315 | 36220 | FLT1:270121 antisense siNA (252 C.) stab00 | GGUCCCAGUAGCUGACCUU | 3077 |
| 354 | AGUUUAAAAGGCACCCAGCACAU | 2316 | 36221 | FLT1:372121 antisense siNA (354 C.) stab00 | GUGCUGGGUGCCUUUAAAUU | 3078 |
| 419 | AGCAGCCCAUAAAUGGUCUUUGC | 2317 | 36222 | FLT1:437L21 antisense siNA (419 C.) stab00 | AAAGACCAUUUAUGGGCUGUU | 3079 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 594 | UCAAAGAAGAAGGAAACAGAAUC | 2318 | 36223 | FLT1:612L21 antisense siNA (594 C.) stab00 | UUCUGUUUCCUUCUUUCUUUUTT | 3080 |
| 595 | CAAAGAAGAAGGAAACAGAAUCU | 2319 | 36224 | FLT1:613L21 antisense siNA (595 C.) stab00 | AUUCUGUUUCCUUCUUUCUUUTT | 3081 |
| 709 | AGCUCGUCAUUCCUGCCGGGUU | 2320 | 36225 | FLT1:727L21 antisense siNA (709 C.) stab00 | CCCGGCAGGGAAUGACGAGUU | 3082 |
| 710 | GCUCGUCAUUCCUGCCGGGUUA | 2321 | 36226 | FLT1:728L21 antisense siNA (710 C.) stab00 | ACCCGGCAGGGAAUGACGAGAUU | 3083 |
| 758 | AAAAAGUUUCCACUUGACACUU | 2322 | 36227 | FLT1:776L21 anhisense siNA (758 C.) stab00 | GUGUCAAGUGGAAACUUUUTT | 3084 |
| 759 | AAAAGUUUCCACUUGACACUUU | 2323 | 36228 | FLT1:777L21 antisense siNA (759 C.) stab00 | AGUGUCAAGUGGAAACUUUTT | 3085 |
| 796 | AACGCAUAAUCUGGGACAGUAGA | 2324 | 36229 | FLT1:814L21 antisense siNA (796 C.) stab00 | UACUGUCCCAGAUUAUGCGUU | 3086 |
| 797 | ACGCAUAAUCUGGGACAGUAGAA | 2325 | 36230 | FLT1:815L21 antisense siNA (797 C.) stab00 | CUACUGUCCCAGAUUAUGCUU | 3087 |
| 798 | CGCAUAAUCUGGGACAGUAGAAA | 2326 | 36231 | FLT1:816L21 antisense siNA (798 C.) stab00 | UCUACUGUCCCAGAUUAUGUU | 3088 |
| 799 | GCAUAAUCUGGGACAGUAGAAAG | 2327 | 36232 | FLT1:817L21 antisense siNA (799 C.) stab00 | UUCUACUGUCCCAGAUUAUUU | 3089 |
| 1220 | CACCUCAGUGCAUAUAUGAUA | 2328 | 36233 | FLT1:1238L21 antisense siNA (1220 C.) stab00 | UCAUAUAUGCACUGAGGUU | 3090 |
| 1438 | CUGAGAGGAUGCAGGGAAUUAU | 2329 | 36234 | FLT1:1456L21 antisense siNA (1438 C.) stab00 | AAUUCCCUGCAUCCUCUCUU | 3091 |
| 1541 | UUACGAAAAGGCCCUGGUCAUCGU | 2330 | 36235 | FLT1:1559L21 antisense siNA (1541 C.) stab0G | GAUGACACCGGCCUUUUCGUU | 3092 |
| 1640 | AAUCAAGUGGUUCUGGCCACCCU | 2331 | 36236 | FLT1:1658L21 antisense siNA (1640 C.) stab00 | GGGUGCCAGAACCACUUGAUU | 3093 |
| 1666 | ACCAUAAUCAUUCCGAAGCAAGG | 2332 | 36237 | FLT1:1684L21 antisense siNA (1666 C.) stab00 | UUGCUUCGGAAUGAUUAUGUU | 3094 |
| 1877 | GACUGUGGAAGAAACACAUAAGCU | 2333 | 36238 | FLT1:1895L21 antisense siNA (1877 C.) stab00 | CUUAUGUUUCUUCCCACAGUU | 3095 |
| 2247 | AACCUCUGAUCUGAUCACAGUGGC | 2334 | 36239 | FLT1:2265L21 antisense siNA (2247 C.) stab00 | CACUGUGUGAUCUGAGGUU | 3096 |
| 2248 | ACCUCUGAUCUGAUCACAGUGGCC | 2335 | 36240 | FLT1:2266L21 antisense siNA (2248 C.) stab00 | CCACUGUGAUCAGAUCACUGAGUU | 3097 |
| 2360 | AGAGCCUGGAAUUAUUUUAGGAC | 2336 | 36241 | FLT1:2378L21 antisense siNA (2360 C.) stab00 | CCUAAAAUAAUUCCAGGCUUU | 3098 |
| 2415 | ACAGAAGAGGAUGAGGUGUCUA | 2337 | 36242 | FLT1:2433L21 antisense siNA (2415 C.) stab00 | GACACCUUCAUCCUCUUCUUU | 3099 |
| 2514 | UCUAAAUCUGGAGCUGAUCACUCU | 2338 | 36243 | FLT1:2532L21 antisense siNA (2514 C.) stab00 | AGUGAUCAGCUCCAGAUUAUU | 3100 |
| 2518 | AUCUGGAGCUGAUCACUCUAACA | 2339 | 36244 | FLT1:2536L21 antisense siNA (2518 C.) stab00 | UUAGAGUGAUCAGCUCCAGUU | 3101 |
| 2703 | AGCAAGUGGGAGUUUGCCCGGGA | 2340 | 36245 | FLT1:2721L21 antisense siNA (2703 C.) stab00 | CCGGGCAAACUCCCACUUGUU | 3102 |
| 2795 | CAUUAAGAAAUCUACCUACCUGCC | 2341 | 36246 | FLT1:2813L21 antisense siNA (2795 C.) stab00 | CACCUAGGUGAUUUCUUAAUU | 3103 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2965 | UGAUGGUGAUUGUUGAAUACUGC | 2342 | 36247 | FLT1:2983L21 antisense siNA (2965 C.) stab00 | AGUAUUCAACAAUCACCAUUTT | 3104 |
| 3074 | GAAAGAAAAAUGGAGCCAGGCC | 2343 | 36248 | FLT1:3092L21 antisense siNA (3074 C.) stab00 | CCUGGCUCCAUUUUCUUTT | 3105 |
| 3100 | ACCAAGGCAAGAAACCAAGACUA | 2344 | 36249 | FLT1:3118L21 antisense siNA (3100 C.) stab00 | GUCUUGGUUUCUUGCCUUGTT | 3106 |
| 3101 | ACAAGGCAAGAAACCAAGACUAG | 2345 | 36250 | FLT1:3119L21 antisense siNA (3101 C.) stab00 | AGCUUGGUUUCUUGCCUUTT | 3107 |
| 3182 | GAGUGAUGUUGAGGAAGAGGAGG | 2346 | 36251 | FLT1:3200L21 antisense siNA (3182 C.) stab00 | UCCUCUUCUCAACAUCACUTT | 3108 |
| 3183 | AGUGAUGUUGAGGAAGAGGAGGA | 2347 | 36252 | FLT1:3201L21 antisense siNA (3183 C.) stab00 | CUCCUCUUCCUCAACAUCATT | 3109 |
| 3253 | CUUACAGUUUUCAAGUGGCCAGA | 2348 | 36253 | FLT1:3271L21 antisense siNA (3253 C.) stab00 | UGGCCACUUGAAAACUGUATT | 3110 |
| 3254 | UUACAGUUUUCAAGUGGCCAGAG | 2349 | 36254 | FLT1:3272L21 antisense siNA (3254 C.) stab00 | CUGGCCACUUGAAAACUGUTT | 3111 |
| 3260 | UUUUCAAGUGGCCAGAGGCAUGG | 2350 | 36255 | FLT1:3278L21 antisense siNA (3260 C.) stab00 | AUGCCUCUGGCCACUUGAATT | 3112 |
| 3261 | UUUCAAGUGGCCAGAGGCAUGGA | 2351 | 36256 | FLT1:3279L21 antisense siNA (3261 C.) stab00 | CAUGCCUCUGGCCACUUGATT | 3113 |
| 3294 | UCCAGAAAAGUGCAUUCAUCGGGA | 2352 | 36257 | FLT1:3312L21 antisense siNA (3294 C.) stab00 | CCGAUGAAUGCACUUUCGTT | 3114 |
| 3323 | AGCCAGAGAAACAUUCUUUUAUCUG | 2353 | 36258 | FLT1:3341L21 antisense siNA (3323 C.) stab00 | GAUAAAGAAUGAUUUCUCGTT | 3115 |
| 3324 | GCCAGAGAAACAUUCUUUUAUCUGA | 2354 | 36259 | FLT1:3342L21 antisense siNA (3324 C.) stab00 | AGAUAAAGAAUGAUUUCCTT | 3116 |
| 3325 | CGAGAGAAACAUUCUUUUAUCUGAG | 2355 | 36260 | FLT1:3343L21 antisense siNA (3325 C.) stab00 | CAGAGAUAAAGAAUGUUUCUTT | 3117 |
| 3513 | UUGCUGUGGGAAAUCUCUCCCUU | 2356 | 36261 | FLT1:3531L21 antisense siNA (3513 C.) stab00 | GGAGAAGAUUUCCCACAGCTT | 3118 |
| 3812 | UGCCUUCUCUGAGGACUUCUUCA | 2357 | 36262 | FLT1:3830L21 antisense siNA (3812 C.) stab00 | AAGAAGUCCUCAGAGAAGGTT | 3119 |
| 3864 | UCAGGAAGCUCUGAUGAUGUCAG | 2358 | 36263 | FLT1:3882L21 antisense siNA (3864 C.) stab00 | GACAUCAUCAGAGCUUCCTT | 3120 |
| 3865 | CAGGAAGCUCUGAUGAUGUCAGA | 2359 | 36264 | FLT1:3883L21 antisense siNA (3865 C.) stab00 | UGACAUCAUCAGAGCUUCCTT | 3121 |
| 3901 | UCAAGUUCAUGAGCCUGGAAAGA | 2360 | 36265 | FLT1:3919L21 antisense siNA (3901 C.) stab00 | UUUCCAGGCUCAUGAACUTT | 3122 |
| 3902 | CAAGUUCAUGAGCCUGGAAAGAA | 2361 | 36266 | FLT1:3920L21 antisense siNA (3902 C.) stab00 | CUUUCCAGGCUCAUGAACUTT | 3123 |
| 3910 | UGAGCCUGGAAAGAAUCAAAACC | 2362 | 36267 | FLT1:3928L21 antisense siNA (3910 C.) stab0G | UUUUGAUUCUUUCCAGGCUTT | 3124 |
| 4136 | CAGCUGUGGGCACGUCAGCGAAG | 2363 | 36268 | FLT1:4154L21 antisense siNA (4136 C.) stab00 | UCGCUGACGUGCCCACAGCTT | 3125 |
| 4154 | CGAAGGCAAGCGCAGGUUCACCU | 2364 | 36269 | FLT1:4172L21 antisense siNA (4154 C.) stab00 | GUGAACCUGCGCUUGCCUUTT | 3126 |
| 4635 | UGCAGCCCAAAACCCAGGGCAAC | 2365 | 36270 | FLT1:4653L21 antisense siNA (4635 C.) stab00 | UGCCCUGGGUUUUGGGCUGTT | 3127 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 4945 | GAGGCAAGAAAAGGACAAAUAUC | 2366 | 36271 | FLT1:4963L21 antisense siNA (4945 C.) stab00 | UAUUUGUCCUUUUCUUGCCUU | 3128 |
| 5090 | UUGGCUCCUCUAGUAAGAUGCAC | 2367 | 36272 | FLT1:5108L21 antisense siNA (5090 C.) stab00 | GCAUCUUACUAGAGGAGCCUU | 3129 |
| 5137 | GUUUCCAGGCCAUGAUGGCCUUA | 2368 | 36273 | FLT1:5155L21 antisense siNA (5137 C.) stab00 | AGGCCAUCAUGGCCUGGAGUU | 3130 |
| 5138 | UCUCCAGGCCAUGAUGGCCUUAC | 2369 | 36274 | FLT1:5156L21 antisense siNA (5138 C.) stab00 | AAGGCCAUCAUGGCCUGGAUU | 3131 |
| 5354 | AGACCCCGUCUCUAUACCAACCA | 2370 | 36275 | FLT1:5372L21 antisense siNA (5354 C.) stab00 | GUUGGUAUAGAGACGGGGUUU | 3132 |
| 5356 | ACCCGUCUCUAUACCAACCAAA | 2371 | 36276 | FLT1:5374L21 antisense siNA (5356 C.) stab00 | UGGUGGUAUAGAGACGGGUU | 3133 |
| 5357 | CCCGUCUCUAUACCAACCAAAC | 2372 | 36277 | FLT1:5375L21 antisense siNA (5357 C.) stab00 | UUGGUGGUAUAGAGACGGUU | 3134 |
| 5707 | GAUCAAGUGGGCCUUGGAUCGCU | 2373 | 36278 | FLT1:5725L21 antisense siNA (5707 C.) stab00 | CGAUCCAAGGCCCACUUGAUU | 3135 |
| 5708 | AUCAAGUGGGCCUUGGAUCGCUA | 2374 | 36279 | FLT1:5726L21 antisense siNA (5708 C.) stab00 | GCGAUCCAAGGCCCACUUGUU | 3136 |
| 346 | CUGAACUGAGUUUAAAAGGCACC | 2296 | 36431 | FLT1:346U21 sense siNA stab00 | GAACUGAGUUUAAAAGGCAUU | 3137 |
| 346 | CUGAACUGAGUUUAAAAGGCACC | 2296 | 36439 | FLT1:364L21 antisense siNA (346 C.) stab00 | UGCCUUUUAAACUCAGUUCUU | 3138 |
| 349 | AACUGAGUUUAAAAGGCACCCAG | 2289 | 36457 | FLT1:349U19 sense siNA stab00 -3' TT | CUGAGUUUAAAAGGCACCC | 3139 |
| 349 | AACUGAGUUUAAAAGGCACCCAG | 2289 | 36458 | FLT1:367L21 antisense siNA (349 C.) stab10 +5' &3' iB | B GGGUGCCUUUUAAACUCAGTsT B | 3140 |
| 349 | AACUGAGUUUAAAAGGCACCCAG | 2289 | 36459 | FLT1:367L19 siRNA (349 C.) stab00 +5' iB-3' TT | B GGGUGCCUUUUAAACUCAG | 3141 |
| 349 | AACUGAGUUUAAAAGGCACCCAG | 2289 | 36460 | FLT1:349U21 sense siNA stab07 -5' &3' iB | cuGAGuuuAAAAGGcAccuTT | 3142 |
| 349 | AACUGAGUUUAAAAGGCACCCAG | 2289 | 36461 | FLT1:349U21 sense siNA stab07 -5' iB -3' TTB | cuGAGuuuAAAAGGcAccc | 3143 |
| 349 | AACUGAGUUUAAAAGGCACCCAG | 2289 | 36462 | FLT1:367L19 siRNA (349 C.) stab08 -3' TsT | GGGuGcccuuuuAAAcucAG | 3144 |
| 2338 | AAAACAACCACAAAUACAACAA | 2375 | 37389 | FLT1:2338U21 sense siNA stab07 | B AAcAAcAcAAAuAcAAcuTT | 3145 |
| 2342 | CAACCACAAAAUACAACAAGAGC | 2376 | 37390 | FLT1:2342U21 sense siNA stab07 | B AccAcAAAAuAcAAcAAGATT | 3146 |
| 2365 | CUGAAAUUAUUUAGGACCAGGA | 2377 | 37391 | FLT1:2365U21 sense siNA stab07 | B GGAAuuAuuuAGGAccAGTT | 3147 |
| 2391 | AGCACGCUGUUUAUUGAAAGAGU | 2378 | 37392 | FLT1:2391U21 sense siNA stab07 | B cAcGcuGuuuAuuGAAAGATT | 3148 |
| 2392 | GCACGCUGUUUAUUGAAAGAGUC | 2379 | 37393 | FLT1:2392U21 sense siNA stab07 | B cGcGuGuuuAuuGAAAGAGTT | 3149 |
| 2393 | CACGCUGUUUAUUGAAAGAGUCA | 2380 | 37394 | FLT1:2393U21 sense siNA stab07 | B GccuGuuuAuuGAAAGAGuTT | 3150 |
| 2394 | ACGCUGUUUAUUGAAAGAGUCAC | 2381 | 37395 | FLT1:2394U21 sense siNA stab07 | B GcuGuuuAuuGAAAGAGucTT | 3151 |
| 2395 | CGCUGUUUAUUGAAAGAGUCACA | 2382 | 37396 | FLT1:2395U21 sense siNA stab07 | B cuGuuuAuuGAAAGAGucATT | 3152 |
| 2396 | GCUGUUUAUUGAAAGAGUCACAG | 2383 | 37397 | FLT1:2396U21 sense siNA stab07 | B uGuuuAuuGAAAGAGucAcTT | 3153 |
| 2397 | CUGUUUAUUGAAAGAGUCACAGA | 2384 | 37398 | FLT1:2397U21 sense siNA stab07 | B GuuuAuuGAAAGAGucAcAGTT | 3154 |
| 2398 | UGUUUAUUGAAAGAGUCACAGAA | 2385 | 37399 | FLT1:2398U21 sense siNA stab07 | B uuuAuuGAAAGAGucAcAGTT | 3155 |
| 2697 | GAUGCCAGCAAGUGGGAGUUGC | 2386 | 37400 | FLT1:2697U21 sense siNA stab07 | B uGccAGcAAGuGGGAGuuuTT | 3156 |
| 2699 | UGCCAGCAAGUGGGAGUUGCCC | 2387 | 37401 | FLT1:2699U21 sense siNA stab07 | B ccAGcAAGuGGGAGuuGcTT | 3157 |
| 2785 | CAGCAUUUGGCAUUAAGAAAUCA | 2388 | 37402 | FLT1:2785U21 sense siNA stab07 | B GcAuuuGGcAuuAAGAAAuTT | 3158 |
| 2786 | AGCAUUUGGCAUUAAGAAAUCAC | 2389 | 37403 | FLT1:2786U21 sense siNA stab07 | B cAuuuGGcAuuAAGAAAucTT | 3159 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2788 | CAUUUGGCAUUAAGAAAUCACCU | 2390 | 37405 | FLT1:2788U21 sense siNA stab07 | B uuuGGcAuuAAGAAAucAcCUTT | 3160 |
| 2789 | AUUUGGCAUUAAGAAAUCACCUA | 2391 | 37406 | FLT1:2789U21 sense siNA stab07 | B uuGGcAuuAAGAAAucAccuTT | 3161 |
| 2812 | CGUGCCGACUGUGGCUGUGAAA | 2392 | 37407 | FLT1:2812U21 sense siNA stab07 | B uGccGAcuGuGGcuGuGATT | 3162 |
| 2860 | GCCGAGUACAAAGCUCUGAUGACU | 2393 | 37408 | FLT1:2860U21 sense siNA stab07 | B GAGuAcAAAGcucuGAuGATT | 3163 |
| 2861 | CGAGUACAAAGCUCUGAUGACUG | 2394 | 37409 | FLT1:2861U21 sense siNA stab07 | B AGuAcAAAGcucuGAuGAcTT | 3164 |
| 2947 | CCAAGCAAGGAGGGCCCUCUGAUG | 2395 | 37410 | FLT1:2947U21 sense siNA stab07 | B AAGcAAGGAGGGcccucuGATT | 3165 |
| 2950 | AGCAAGGAGGGCCCUCUGAUGUG | 2396 | 37411 | FLT1:2950U21 sense siNA stab07 | B cAAGGAGGGcccucuGAuGUTT | 3166 |
| 2952 | CAAGGAGGGCCCUCUGAUGUGAU | 2397 | 37412 | FLT1:2952U21 sense siNA stab07 | B AGGAGGGcccucuGAuGuGTT | 3167 |
| 2953 | AAGGAGGGCCCUCUGAUGUGAUU | 2398 | 37413 | FLT1:2953U21 sense siNA stab07 | B GGAGGGcccucuGAuGuGATT | 3168 |
| 2954 | AGGAGGGCCCUCUGAUGUGAUUG | 2399 | 37414 | FLT1:2954U21 sense siNA stab07 | B GAGGGcccucuGAuGuGAuTT | 3169 |
| 3262 | UUCAAGUGGCCAGAGGCCAUGGAG | 2400 | 37415 | FLT1:3262U21 sense siNA stab07 | B cAAGuGGccAGAGGccAuGGTT | 3170 |
| 3263 | UCAAGUGGCCAGAGGCCAUGGAGU | 2401 | 37416 | FLT1:3263U21 sense siNA stab07 | B AAGuGGccAGAGGccAuGATT | 3171 |
| 3266 | AGUGGCCAGAGGCCAUGGAGUUCC | 2402 | 37417 | FLT1:3266U21 sense siNA stab07 | B uGGccAGAGGccAuGGAGuuTT | 3172 |
| 3911 | GAGCCUGGAAAGAAUCAAAACCU | 2403 | 37418 | FLT1:3911U21 sense siNA stab07 | B GccuGGAAAGAAucAAAAcTT | 3173 |
| 4419 | UUUUUGACUAACAAGAAUGUAA | 2404 | 37419 | FLT1:4419U21 sense siNA stab07 | B uuuuGAcuAAcAAGAAuGuTT | 3174 |
| 346 | CUGAACUGAGUUUAAAAGGCACC | 2296 | 37420 | FLT1:364L21 antisense siNA (346 C.) stab26 | UGCcuuuuAAAcucAGuuTT | 3175 |
| 347 | UGAACUGAGUUUAAAAGGCACCC | 2297 | 37421 | FLT1:365L21 antisense siNA (347 C.) stab26 | GUGccuuuuAAAcucAGuuTT | 3176 |
| 349 | AACUGAGUUUAAAAGGCACCCAG | 2289 | 37422 | FLT1:367L21 antisense siNA (349 C.) stab26 | GGGuGccuuuuAAAcucAGTT | 3177 |
| 351 | CUGAGUUUAAAAGGCACCCAGCA | 2300 | 37423 | FLT1:369L21 antisense siNA (351 C.) stab26 | CUGGGuGccuuuuAAAcucTT | 3178 |
| 353 | GAGUUUAAAAGGCACCCAGCACA | 2302 | 37424 | FLT1:371L21 antisense siNA (353 C.) stab26 | UGCuGGGuGccuuuuAAATT | 3179 |
| 1956 | GAAGGAGGACCUGAAACUGUC | 2286 | 37425 | FLT1:1974L21 antisense siNA (1956 C.) stab26 | CAGuuucAGGuccucucuuTT | 3180 |
| 1957 | AAGGAGGACCUGAAACUGUCU | 2287 | 37426 | FLT1:1975L21 antisense siNA (1957 C.) stab26 | ACAGuuucAGGuccucucTT | 3181 |
| 2338 | AAAACAACCACAAAAUACAACAA | 2375 | 37427 | FLT1:2356L21 antisense siNA (2338 C.) stab26 | GUGuAuuuuGuGGuuGuuTT | 3182 |
| 2340 | AACAACCACAAAAUACAACAAGA | 2292 | 37428 | FLT1:2358L21 antisense siNA (2340 C.) stab26 | UUGuuGuAuuuuGuGGuuGTT | 3183 |
| 2342 | CAACCACAAAAUACAACAAGAGC | 2376 | 37429 | FLT1:2360L21 antisense siNA (2342 C.) stab26 | UCUuGuuGuAuuuuGuGGuTT | 3184 |
| 2365 | CUGGAAUAUUUAGGACCAGGA | 2377 | 37430 | FLT1:2383L21 antisense siNA (2365 C.) stab26 | CUGGuccuAAAuAuuccTT | 3185 |
| 2391 | AGCACGCUGUUUAUUGAAAGAGU | 2378 | 37431 | FLT1:2409L21 antisense siNA (2391 C.) stab26 | UCUuucAAuAAAcAGcGuTT | 3186 |
| 2392 | GCACGCUGUUUAUUGAAAGAGUC | 2379 | 37432 | FLT1:2410L21 antisense siNA (2392 C.) stab26 | CUCuuucAAuAAAcAGcGuTT | 3187 |
| 2393 | CACGCUGUUUAUUGAAAGAGUCA | 2380 | 37433 | FLT1:2411L21 antisense siNA (2393 C.) stab26 | ACUcuuucAAuAAAcAGcGTT | 3188 |
| 2394 | ACGCUGUUUAUUGAAAGAGUCAC | 2381 | 37434 | FLT1:2412L21 antisense siNA (2394 C.) stab26 | GACucuuucAAuAAAcAGTT | 3189 |
| 2395 | CGCUGUUUAUUGAAAGAGUCACA | 2382 | 37435 | FLT1:2413L21 antisense siNA (2395 C.) stab26 | UGAcucuuucAAuAAAcAGTT | 3190 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2396 | GCUGUUUAUUGAAAGAGUCACAG | 2383 | 37436 | FLT1:2414L21 antisense siNA (2396 C.) stab26 | GUGAcucuuucAAuAAAcATT | 3191 |
| 2397 | CUGUUUAUUGAAAGAGUCACAGA | 2384 | 37437 | FLT1:2415L21 antisense siNA (2397 C.) stab26 | UGUGActcuuucAAuAAAcTT | 3192 |
| 2398 | UGUUUAUUGAAAGAGUCACAGAA | 2385 | 37438 | FLT1:2416L21 antisense siNA (2398 C.) stab26 | CUGuGActcuuucAAuAAATT | 3193 |
| 2697 | GAUGCCAGCAGUGGGAGUUUGC | 2386 | 37439 | FLT1:2715L21 antisense siNA (2697 C.) stab26 | AAAcucccActucGcuGGcATT | 3194 |
| 2699 | UGCCAGCAGUGGGAGUUUGCCC | 2387 | 37440 | FLT1:2717L21 antisense siNA (2699 C.) stab26 | GCAAAcucccActuuGcuGTT | 3195 |
| 2785 | CAGCAUUUGGCAUUAAGAAAUCA | 2388 | 37441 | FLT1:2803L21 antisense siNA (2785 C.) stab26 | AUUucuuAAuGccAAAucTT | 3196 |
| 2786 | AGCAUUUGGCAUUAAGAAAUCAC | 2389 | 37442 | FLT1:2804L21 antisense siNA (2786 C.) stab26 | GAUuuCuuAAuGccAAAuGTT | 3197 |
| 2787 | GCAUUUGGCAUUAAGAAAUCACC | 2288 | 37443 | FLT1:2805L21 antisense siNA (2787 C.) stab26 | UGAuucuuAAuGccAAAuTT | 3198 |
| 2788 | CAUUUGGCAUUAAGAAAUCACCU | 2390 | 37444 | FLT1:2806L21 antisense siNA (2788 C.) stab26 | GUGAuucuuAAuGccAAATT | 3199 |
| 2789 | AUUUGGCAUUAAGAAAUCACCUA | 2391 | 37445 | FLT1:2807L21 antisense siNA (2789 C.) stab26 | GGUGAuucuuAAuGccAATT | 3200 |
| 2812 | CGUGCCGGACUGUGGCUCUGAAA | 2392 | 37446 | FLT1:2830L21 antisense siNA (2812 C.) stab26 | UCAcAGccAcAGucCGGcATT | 3201 |
| 2860 | GCGAGUACAAAGCUCUGAUGACU | 2393 | 37447 | FLT1:2878L21 antisense siNA (2860 C.) stab26 | UCAucAGAGcuuuGuAcucTT | 3202 |
| 2861 | CGAGUACAAAGCUCUGAUGACUG | 2394 | 37448 | FLT1:2879L21 antisense siNA (2861 C.) stab26 | GUCAGuAGAGcuuuGuAcuTT | 3203 |
| 2947 | CCAAGCAAGGAGGGCCCUCUGAUGGU | 2395 | 37449 | FLT1:2965L21 antisense siNA (2947 C.) stab26 | UCAGAGGGcccuccuGcuuTT | 3204 |
| 2949 | AAGCAAGGAGGGCCUCUCUGAUGGU | 2290 | 37450 | FLT1:2967L21 antisense siNA (2949 C.) stab26 | CAUcAGAGGccucccuuGcTT | 3205 |
| 2950 | AGCAAGGAGGGCCUCUCUGAUGGUG | 2396 | 37451 | FLT1:2968L21 antisense siNA (2950 C.) stab26 | CCAucAGAGGcccucccuuGTT | 3206 |
| 2952 | CAAGGAGGGCCUCUCUGAUGGUGAU | 2397 | 37452 | FLT1:2970L21 antisense siNA (2952 C.) stab26 | CACccAucAGAGGcccuccuTT | 3207 |
| 2953 | AAGGAGGGCCUCUCUGAUGGUGAUU | 2398 | 37453 | FLT1:2971L21 antisense siNA (2953 C.) stab26 | UCAccAucAGAGGcccuccTT | 3208 |
| 2954 | AGGAGGGCCUCUCUGAUGGUGAUUG | 2399 | 37454 | FLT1:2972L21 antisense siNA (2954 C.) stab26 | AUCAccAucAGAGGcccuuGTT | 3209 |
| 3262 | UUCAAGUGGCCAGAGGCAUGGAG | 2400 | 37455 | FLT1:3280L21 antisense siNA (3262 C.) stab26 | CCAuGccucuGGccActuGTT | 3210 |
| 3263 | UCAAGUGGCCAGAGGCAUGGAGU | 2401 | 37456 | FLT1:3281L21 antisense siNA (3263 C.) stab26 | UCCAuGccucuGGccActuuTT | 3211 |
| 3266 | AGUGGCCAGAGGCAUGGAGUUCC | 2402 | 37457 | FLT1:3284L21 antisense siNA (3266 C.) stab26 | AACuccAuGcccucuGGccATT | 3212 |
| 3911 | GAGCCUGGAAAGAAUCAAAACCU | 2403 | 37458 | FLT1:3929L21 antisense siNA (3911 C.) stab26 | GUUuuGAuucuuuccAGGcTT | 3213 |
| 4419 | UUUUUUGACUAACAAGAUGUAA | 2404 | 37459 | FLT1:4437L21 antisense siNA (4419 C.) stab26 | ACAuucuuGuuAGucAAAATT | 3214 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3646 | UCAUGCUGGACUGCUGGCACAGA | 2195 | 37576 | stab26 FLT1:3664L21 antisense siNA (3646 C.) stab26 | UGUGCcAGcAGucCAGcAuTT | 3215 |
| 349 | AACUGAGUUUAAAAGGCACCCAG | 2289 | 38285 | 5'CB 31270 FLT1:349U21 sense siNA stab09 | CBUGAGUUUAAAAGGCACCCTT B | 3216 |
| VEGFR2 | | | | | | |
| 3304 | UGACCUUGGAGCAUCUCAUCUGU | 2405 | | KDR:3304U21 sense siNA stab04 | B AccuUGGAGcAucucAucuTT B | 3217 |
| 3894 | UCACCUGUUUCCUGUAUGGAGGA | 2406 | | KDR:3894U21 sense siNA stab04 | B AccuGuuuccuGuAuGGAGTT B | 3218 |
| 3304 | UGACCUUGGAGCAUCUCAUCUGU | 2405 | | KDR:3322L21 antisense siNA (3304 C.) stab05 | AGAuGAGAuGCuccAAGGuTsT | 3219 |
| 3894 | UCACCUGUUUCCUGUAUGGAGGA | 2406 | | KDR:3912L21 antisense siNA (3894 C.) stab05 | cuccAuAcAGGAAAcAGGuTsT | 3220 |
| 3304 | UGACCUUGGAGCAUCUCAUCUGU | 2405 | | KDR:3304U21 sense siNA stab07 | B AccuUGGAGcAucucAucuTT B | 3221 |
| 3894 | UCACCUGUUUCCUGUAUGGAGGA | 2406 | 32766 | KDR:3894U21 sense siNA stab07 | B AccuGuuuccuGuAuGGAGTT B | 3222 |
| 3304 | UGACCUUGGAGCAUCUCAUCUGU | 2405 | | KDR:3322L21 antisense siNA (3304 C.) stab11 | AGAuGAGAuGCuccAAGGuTsT | 3223 |
| 3854 | UUUGAGCAUGGAAGAGGAUUCUG | 2407 | | KDR:3872L21 antisense siNA (3854 C.) stab11 | GAAuccucuuccAuGcucATsT | 3224 |
| 3894 | UCACCUGUUUCCUGUAUGGAGGA | 2406 | | KDR:3912L21 antisense siNA (3894 C.) stab11 | cuccAuAcAGGAAAcAGGuTsT | 3225 |
| 3948 | GACAACAGCAGGAAUCAGAGUCA | 2408 | | KDR:3966L21 antisense siNA (3948 C.) stab11 | AcuGAuuccuGcuGuuGTsT | 3226 |
| 3076 | UGUCCACUUACCUGAGGAGCAAG | 2409 | 30785 | KDR:3076U21 sense siNA stab04 | B uccAcuuAccuGAGGAGcATT B | 3227 |
| 3854 | UUUGAGCAUGGAAGAGGAUUCUG | 2407 | 30786 | KDR:3854U21 sense siNA stab04 | B uGAGcAUGGAAGAGGAuucTT B | 3228 |
| 4089 | AUGGUUCUGCCUCAGAAGAGCU | 2410 | 30787 | KDR:4089U21 sense siNA stab04 | B GGuucuGccucAGAAGAGTT B | 3229 |
| 4191 | UCUGAAGGCUCAAACCAGACAAG | 2411 | 30788 | KDR:4191U21 sense siNA stab04 | B uGAAGGcucAAAccAGAcATT B | 3230 |
| 3076 | UGUCCACUUACCUGAGGAGCAAG | 2409 | 30789 | KDR:3094L21 antisense siNA (3076 C.) stab05 | uGcuccucAGGuAAGuGGATsT | 3231 |
| 3854 | UUUGAGCAUGGAAGAGGAUUCUG | 2407 | 30790 | KDR:3872L21 antisense siNA (3854 C.) stab05 | GAAuccucuuccAuGcucATsT | 3232 |
| 4089 | AUGGUUCUGCCUCAGAAGAGCU | 2410 | 30791 | KDR:4107L21 antisense siNA (4089 C.) stab05 | cucucucuGAGGcAAGAAccTsT | 3233 |
| 4191 | UCUGAAGGCUCAAACCAGACAAG | 2411 | 30792 | KDR:4209L21 antisense siNA (4191 C.) stab05 | uGucuGGuuuGAGccuucATsT | 3234 |
| 3076 | UGUCCACUUACCUGAGGAGCAAG | 2409 | 31426 | KDR:3076U21 sense siNA | UCCACUUACCUGAGGAGCAUU | 3235 |
| 3854 | UUUGAGCAUGGAAGAGGAUUCUG | 2407 | 31435 | KDR:3854U21 sense siNA | UGAGCAUGGAAGAGGAUUCUU | 3236 |
| 4089 | AUGGUUCUGCCUCAGAAGAGCU | 2410 | 31428 | KDR:4089U21 sense siNA | GGUUCUGCCUCAGAAGAGUU | 3237 |
| 4191 | UCUGAAGGCUCAAACCAGACAAG | 2411 | 31429 | KDR:4191U21 sense siNA | UGAAGGCUCAAACCAGACAUU | 3238 |
| 3076 | UGUCCACUUACCUGAGGAGCAAG | 2409 | 31430 | KDR:3094L21 antisense siNA (3076 C.) | UGCUCCUCAGGUAAGUGGAUU | 3239 |
| 3854 | UUUGAGCAUGGAAGAGGAUUCUG | 2407 | 31439 | KDR:3872L21 antisense siNA (3854 C.) | GAAUCCUCUUCCAUGCUCAUU | 3240 |
| 4089 | AUGGUUCUGCCUCAGAAGAGCU | 2410 | 31432 | KDR:4107L21 antisense siNA (4089 C.) | CUCUCUGAGGCAAGAACCUU | 3241 |
| 4191 | UCUGAAGGCUCAAACCAGACAAG | 2411 | 31433 | KDR:4209L21 antisense siNA (4191 C.) | UGUCUGGUUUGAGCCUUCAUU | 3242 |
| 3304 | UGACCUUGGAGCAUCUCAUCUGU | 2405 | 31434 | KDR:3304U21 sense siNA | ACCUUGGAGCAUCUCAUCUUU | 3243 |
| 3894 | UCACCUGUUUCCUGUAUGGAGGA | 2406 | 31436 | KDR:3894U21 sense siNA | ACCUGUUUCCUGUAUGGAGUU | 3244 |
| 3948 | GACAACAGCAGGAAUCAGAGUCA | 2408 | 31437 | KDR:3948U21 sense siNA | CAACAGCAGGAAUCAGAUU | 3245 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3304 | UGACCUUGGAGCAUCUCAUCUGU | 2405 | 31438 | KDR:3322L21 antisense siNA (3304 C.) | AGAUGAGAUGCUCCAAGGUTT | 3246 |
| 3894 | UCACCUGUGUUCCUGUAUGGAGGA | 2406 | 31440 | KDR:3912L21 antisense siNA (3894 C.) | CUCCAUACAGGAAACAGGUTT | 3247 |
| 3948 | GACAACACAGCAGGAAUCAGUCA | 2408 | 31441 | KDR:3966L21 antisense siNA (3948 C.) | ACUGAUUCCUGCUGUGUUGTT | 3248 |
| 3948 | GACAACACAGCAGGAAUCAGUCA | 2408 | 31856 | KDR:3948U21 sense siNA stab04 | B cAAcAcAgcAGGAAucAGuTT B | 3249 |
| 3948 | GACAACACAGCAGGAAUCAGUCA | 2408 | 31857 | KDR:3966L21 antisense siNA (3948 C.) stab05 | AcuGAuuccuGcuGuGuuGTsT | 3250 |
| 3854 | UUUGAGCAUGGAAGAGGAUUCUG | 2407 | 31858 | KDR:3854U21 sense siNA stab07 | B uGAGcAuGGAAGAGGAuucTT B | 3251 |
| 3948 | GACAACACAGCAGGAAUCAGUCA | 2408 | 31859 | KDR:3948U21 sense siNA stab07 | B cAAcAcAgcAGGAAucAGuTT B | 3252 |
| 3854 | UUUGAGCAUGGAAGAGGAUUCUG | 2407 | 31860 | KDR:3872L21 antisense siNA (3854 C.) | GAAuccuuccuAuGcucATsT | 3253 |
| 3948 | GACAACACAGCAGGAAUCAGUCA | 2408 | 31861 | KDR:3966L21 antisense siNA (3948 C.) stab08 | AcuGAuuccuGcuGuGuuGTsT | 3254 |
| 3854 | UUUGAGCAUGGAAGAGGAUUCUG | 2407 | 31862 | KDR:3854U21 sense siNA stab09 | B UGAGCAUGGAAGAGGAUUCTT | 3255 |
| 3948 | GACAACACAGCAGGAAUCAGUCA | 2408 | 31863 | KDR:3948U21 sense siNA stab09 | B CAACACAGCAGGAAUCAGUTT | 3256 |
| 3854 | UUUGAGCAUGGAAGAGGAUUCUG | 2407 | 31864 | KDR:3872L21 antisense siNA (3854 C.) stab10 | GAAUCCUCUUCCAUGCUCATsT | 3257 |
| 3948 | GACAACACAGCAGGAAUCAGUCA | 2408 | 31865 | KDR:3966L21 antisense siNA (3948 C.) stab10 | ACUGAUUCCUGCUGUGUUGTsT | 3258 |
| 3854 | UUUGAGCAUGGAAGAGGAUUCUG | 2407 | 31878 | KDR:3854U21 sense siNA inv stab04 | B cuuAGGAGAAGGuAcGAGuTT B | 3259 |
| 3948 | GACAACACAGCAGGAAUCAGUCA | 2408 | 31879 | KDR:3948U21 sense siNA inv stab04 | B uGAcuAAGGAcAcAcAAcTT B | 3260 |
| 3854 | UUUGAGCAUGGAAGAGGAUUCUG | 2407 | 31880 | KDR:3872L21 antisense siNA (3854 C.) inv stab05 | AcucGuAccuuccuAAGTsT | 3261 |
| 3948 | GACAACACAGCAGGAAUCAGUCA | 2408 | 31881 | KDR:3966L21 antisense siNA (3948 C.) inv stab05 | GuuGuGucGuccuuAGucATsT | 3262 |
| 3854 | UUUGAGCAUGGAAGAGGAUUCUG | 2407 | 31882 | KDR:3854U21 sense siNA inv stab07 | B cuuAGGAGAAGGuAcGAGuTT B | 3263 |
| 3948 | GACAACACAGCAGGAAUCAGUCA | 2408 | 31883 | KDR:3948U21 sense siNA inv stab07 | B uGAcuAAGGAcAcAcAAcTT B | 3264 |
| 3854 | UUUGAGCAUGGAAGAGGAUUCUG | 2407 | 31884 | KDR:3872L21 antisense siNA (3854 C.) inv stab08 | AcucGuAccuuccuAAGTsT | 3265 |
| 3948 | GACAACACAGCAGGAAUCAGUCA | 2408 | 31885 | KDR:3966L21 antisense siNA (3948 C.) inv stab08 | GuuGuGucGuccuuAGucATsT | 3266 |
| 3854 | UUUGAGCAUGGAAGAGGAUUCUG | 2407 | 31886 | KDR:3854U21 sense siNA inv stab09 | B CUUAGGAGAAGGUACGAGUTT | 3267 |
| 3948 | GACAACACAGCAGGAAUCAGUCA | 2408 | 31887 | KDR:3948U21 sense siNA inv stab09 | B UGACUAAGGACACACAACTT | 3268 |
| 3854 | UUUGAGCAUGGAAGAGGAUUCUG | 2407 | 31888 | KDR:3872L21 antisense siNA (3854 C.) inv stab10 | ACUCGUACCUUCCUAAGTsT | 3269 |
| 3948 | GACAACACAGCAGGAAUCAGUCA | 2408 | 31889 | KDR:3966L21 antisense siNA (3948 C.) inv stab10 | GUUGUGUCGUCCUUAGUCATsT | 3270 |
| 2764 | CCUUAUGAUGCCAGCAGCAAAU | 2412 | 32238 | KDR:2764U21 sense siNA | CCUUAUGAUGCCAGCAAAUTT | 3271 |
| 2765 | CUUAUGAUGCCAGCAGCAAAUG | 2413 | 32239 | KDR:2765U21 sense siNA | CUUAUGAUGCCAGCAAAUGTT | 3272 |
| 2766 | UUAUGAUGCCAGCAGCAAAUGG | 2414 | 32240 | KDR:2766U21 sense siNA | UUAUGAUGCCAGCAAAUGGTT | 3273 |
| 2767 | UAUGAUGCCAGCAGCAAAUGGG | 2415 | 32241 | KDR:2767U21 sense siNA | UAUGAUGCCAGCAAAUGGGTT | 3274 |
| 2768 | AUGAUGCCAGCAGCAAAUGGGA | 2416 | 32242 | KDR:2768U21 sense siNA | AUGAUGCCAGCAAAUGGGATT | 3275 |
| 3712 | CAGACCAUGCUGGACUGCU | 2417 | 32243 | KDR:3712U21 sense siNA | CAGACCAUGCUGGACUGCUTT | 3276 |
| 3713 | AGACCAUGCUGGACUGCUG | 2418 | 32244 | KDR:3713U21 sense siNA | AGACCAUGCUGGACUGCUGTT | 3277 |
| 3714 | GACCAUGCUGGACUGCUGG | 2419 | 32245 | KDR:3714U21 sense siNA | GACCAUGCUGGACUGCUGGTT | 3278 |
| 3715 | ACCAUGCUGGACUGCUGGC | 2420 | 32246 | KDR:3715U21 sense siNA | ACCAUGCUGGACUGCUGGCTT | 3279 |
| 3716 | CCAUGCUGGACUGCUGGCA | 2421 | 32247 | KDR:3716U21 sense siNA | CCAUGCUGGACUGCUGGCATT | 3280 |
| 3811 | CAGGAUGGCAAAGACUACA | 2422 | 32248 | KDR:3811U21 sense siNA | CAGGAUGGCAAAGACUACATT | 3281 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3812 | AGGAUGGCAAAGACUACAU | 2423 | 32249 | KDR:3812U21 sense siNA | AGGAUGGCAAAGACUACAUTT | 3282 |
| 2764 | CCUUAUGAUGCCAGCAAAU | 2412 | 32253 | KDR:2782L21 antisense siNA (2764 C.) | AUUUGCUGGCAUCAUAAGGTT | 3283 |
| 2765 | CUUAUGAUGCCAGCAAAUG | 2413 | 32254 | KDR:2783L21 antisense siNA (2765 C.) | CAUUUGCUGGCAUCAUAAGTT | 3284 |
| 2766 | UUAUGAUGCCAGCAAAUGG | 2414 | 32255 | KDR:2784L21 antisense siNA (2766 C.) | CCAUUUGCUGGCAUCAUAATT | 3285 |
| 2767 | UAUGAUGCCAGCAAAUGGG | 2415 | 32256 | KDR:2785L21 antisense siNA (2767 C.) | CCCAUUUGCUGGCAUCAUATT | 3286 |
| 2768 | AUGAUGCCAGCAAAUGGGA | 2416 | 32257 | KDR:2786L21 antisense siNA (2768 C.) | UCCCAUUUGCUGGCAUCAUTT | 3287 |
| 3712 | CAGACCAUGCUGGACUGCU | 2417 | 32258 | KDR:3730L21 antisense siNA (3712 C.) | AGCAGUCCAGCAUGGUCUGTT | 3288 |
| 3713 | AGACCAUGCUGGACUGCUG | 2418 | 32259 | KDR:3731L21 antisense siNA (3713 C.) | CAGCAGUCCAGCAUGGUCUTT | 3289 |
| 3714 | GACCAUGCUGGACUGCUGG | 2419 | 32260 | KDR:3732L21 antisense siNA (3714 C.) | CCAGCAGUCCAGCAUGGUCTT | 3290 |
| 3715 | ACCAUGCUGGACUGCUGGC | 2420 | 32261 | KDR:3733L21 antisense siNA (3715 C.) | GCCAGCAGUCCAGCAUGGUTT | 3291 |
| 3716 | CCAUGCUGGACUGCUGGCA | 2421 | 32262 | KDR:3734L21 antisense siNA (3716 C.) | UGCCAGCAGUCCAGCAUGGTT | 3292 |
| 3811 | CAGGAUGGCAAAGACUACA | 2422 | 32263 | KDR:3829L21 antisense siNA (3811 C.) | UGUAGUCUUUGCCAUCCUGTT | 3293 |
| 3812 | AGGAUGGCAAAGACUACAU | 2423 | 32264 | KDR:3830L21 antisense siNA (3812 C.) | AUGUAGUCUUUGCCAUCCUTT | 3294 |
| 3304 | UGACCUUGCGUUCUAUGGAGCAUCUCAUCUGU | 2405 | 32310 | KDR:3304U21 sense siNA stab09 | B ACCUUGGAGCAUCUCAUCUTT | 3295 |
| 3894 | UCACCUGUUCCUGUAUGGAGGA | 2406 | 32311 | KDR:3894U21 sense siNA stab09 | B ACCUGUUCCUGUAUGGAGTT | 3296 |
| 3304 | UGACCUUGGAGCAUCUCAUCUGU | 2405 | 32312 | KDR:3322L21 antisense siNA (3304 C.) stab10 | AGAUGAGAUGCUCCAAGGUTsT | 3297 |
| 3894 | UCACCUGUUCCUGUAUGGAGGA | 2406 | 32313 | KDR:3912L21 antisense siNA (3894 C.) stab10 | CUCCAUACAGGAAACAGGUTsT | 3298 |
| 3304 | UGACCUUGGAGCAUCUCAUCUGU | 2405 | 32314 | KDR:3304U21 sense siNA inv stab09 | B UCUACUACGAGAGGUUCCATT | 3299 |
| 3894 | UCACCUGUUCCUGUAUGGAGGA | 2406 | 32315 | KDR:3894U21 sense siNA inv stab09 | B GAGGUAUGCUCCUUUGUCCATT | 3300 |
| 3304 | UGACCUUGGAGCAUCUCAUCUGU | 2405 | 32316 | KDR:3322L21 antisense siNA (3304 C.) stab10 | inv UGGAACCUCGUAGAGUAGATsT | 3301 |
| 3894 | UCACCUGUUCCUGUAUGGAGGA | 2406 | 32317 | KDR:3912L21 antisense siNA (3894 C.) stab10 | inv UGGA-CAAAG-GACAUACCUCTsT | 3302 |
| 828 | AACAGAAUUCCUGGGACAGCAA | 2424 | 32762 | KDR:828U21 sense siNA stab08 | B cAGAAuuccGGGAcAGcTT | 3303 |
| 3310 | UGGAGCAUCUCAGAGUUGUACAGC | 2425 | 32763 | KDR:3310U21 sense siNA stab07 | B GAGcAucucAucucuAcAGTT | 3304 |
| 3758 | CACGUUUUCAGAGUUGGUGGAAC | 2426 | 32764 | KDR:3758U21 sense siNA stab07 | B cGuuuucAGAGuuGGuGGATT | 3305 |
| 3893 | CUCACCUGUUCCUGUAUGGAGG | 2427 | 32765 | KDR:3893U21 sense siNA stab07 | B cAccuGuuccuGuAuGGATT | 3306 |
| 828 | AACAGAAUUCCUGGGACAGCAA | 2424 | 32767 | KDR:846L21 antisense siNA (828 C.) stab08 | GcuGuccCAGGAAuucuGTcTT | 3307 |
| 3310 | UGGAGCAUCUCAGAGUUGUACAGC | 2425 | 32768 | KDR:3328L21 antisense siNA (3310 C.) stab08 | uGuAAcAGAuGAGAuGcucTsT | 3308 |
| 3758 | CACCUGUUUCAGAGUUGGUGGAAC | 2426 | 32769 | KDR:3776L21 antisense siNA (3758 C.) stab08 | uccAccAAcucuGAAAAcGTsT | 3309 |
| 3893 | CUCACCUGUUCCUGUAUGGAGG | 2427 | 32770 | KDR:3911L21 antisense siNA (3893 C.) stab08 | uccAuAcAGGAAAcAGGuGTsT | 3310 |
| 3894 | UCACCUGUUCCUGUAUGGAGGA | 2406 | 32771 | KDR:3912L21 antisense siNA (3894 C.) stab08 | cucCAuAcAGGAAAcAGGuGTsT | 3311 |
| 828 | AACAGAAUUCCUGGGACAGCAA | 2424 | 32786 | KDR:828U21 sense siNA inv stab07 | B cGAcAGGGuccuuuAAGAcTT | 3312 |
| 3310 | UGGAGCAUCUCAGAGUUGUACAGC | 2425 | 32787 | KDR:3310U21 sense siNA inv stab07 | B AcAuuGucuAcucuAcGAGTT | 3313 |
| 3758 | CACGUUUUCAGAGUUGGUGGAAC | 2426 | 32788 | KDR:3758U21 sense siNA inv stab07 | B AGGuGGuuGAGAcuuuuGcTT | 3314 |
| 3893 | CUCACCUGUUCCUGUAUGGAGG | 2427 | 32789 | KDR:3893U21 sense siNA inv stab07 | B AGGuAuGGuccuuuGuccAcTT | 3315 |
| 3894 | UCACCUGUUCCUGUAUGGAGGA | 2406 | 32790 | KDR:3894U21 sense siNA inv stab07 | B GAGGuAuGGuccuuuGuccATT | 3316 |
| 828 | AACAGAAUUCCUGGGACAGCAA | 2424 | 32791 | KDR:846L21 antisense siNA (828 C.) inv stab08 | GucuuAAAGGAcccuGucGTsT | 3317 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3310 | UGGAGCAUCUCAGCUGUUACAGC | 2425 | 32792 | KDR:3328L21 antisense siNA (3310 C.) inv stab08 | CucGAGAGuAGCAuGuTsT | 3318 |
| 3758 | CACGUUUUCAGAGUUGGUGGAAC | 2426 | 32793 | KDR:3776L21 antisense siNA (3758 C.) inv stab08 | GcAAAGucucAccAccuTsT | 3319 |
| 3893 | CUCACCUGUUUCCUGUAUGGAGG | 2427 | 32794 | KDR:3911L21 antisense siNA (3893 C.) inv stab08 | GuGGAcAAAGGAcAuAccuTsT | 3320 |
| 3894 | UCACCUGUUUCCUGUAUGGAGGA | 2406 | 32795 | KDR:3912L21 antisense siNA (3894 C.) inv stab08 | uGGAcAAAGGAcAuAccucTsT | 3321 |
| 828 | AACAGAAUUCCUGGGACAGCAA | 2424 | 32958 | KDR:828U21 sense siNA stab09 | B CAGAAUUCCUGGGACAGCUU | 3322 |
| 3310 | UGGAGCAUCUCAGCUGUUACAGC | 2425 | 32959 | KDR:3310U21 sense siNA stab09 | B GAGCAUUCUACUCUGUUACAUU | 3323 |
| 3758 | CACGUUUUCAGAGUUGGUGGAAC | 2426 | 32960 | KDR:3758U21 sense siNA stab09 | B CGUUUCAGAGUUGGUGGAUU | 3324 |
| 3893 | CUCACCUGUUUCCUGUAUGGAGG | 2427 | 32961 | KDR:3893U21 sense siNA stab09 | B CACCUGUUUCCUGUAUGGAUU | 3325 |
| 828 | AACAGAAUUCCUGGGACAGCAA | 2424 | 32963 | KDR:846L21 antisense siNA (828 C.) stab10 | GCUGUCCCAGGAAUUCUGUUsT | 3326 |
| 3310 | UGGAGCAUCUCAGCUGUUACAGC | 2425 | 32964 | KDR:3328L21 antisense siNA (3310 C.) stab10 | UGUAACAGAGAUGAGCUCUsT | 3327 |
| 3758 | CACGUUUUCAGAGUUGGUGGAAC | 2426 | 32965 | KDR:3776L21 antisense siNA (3758 C.) stab10 | UCCACCAACUCUGAAAACGTsT | 3328 |
| 3893 | CUCACCUGUUUCCUGUAUGGAGG | 2427 | 32966 | KDR:3911L21 antisense siNA (3893 C.) stab10 | UCCAUACAGGAAACAGGUGTsT | 3329 |
| 828 | AACAGAAUUCCUGGGACAGCAA | 2424 | 32988 | KDR:828U21 sense siNA inv stab09 | B CGACAGGGUCCUUUAAGACUU | 3330 |
| 3310 | UGGAGCAUCUCAGCUGUUACAGC | 2425 | 32989 | KDR:3310U21 sense siNA inv stab09 | B ACAUGUCUACUCUACCAGUU | 3331 |
| 3758 | CACGUUUUCAGAGUUGGUGGAAC | 2426 | 32990 | KDR:3758U21 sense siNA inv stab09 | B AGGUGGUUGAGACUUUUGCUU | 3332 |
| 3893 | CUCACCUGUUUCCUGUAUGGAGG | 2427 | 32991 | KDR:3893U21 sense siNA inv stab09 | B AGGUAGUCCUUUGUCCACUU | 3333 |
| 828 | AACAGAAUUCCUGGGACAGCAA | 2424 | 32993 | KDR:846L21 antisense siNA (828 C.) inv stab10 | GUCUUAAAGGACCCUGUCGTsT | 3334 |
| 3310 | UGGAGCAUCUCAGCUGUUACAGC | 2425 | 32994 | KDR:3328L21 antisense siNA (3310 C.) inv stab10 | CUCUAGAGUAGACAAUGTsT | 3335 |
| 3758 | CACGUUUUCAGAGUUGGUGGAAC | 2426 | 32995 | KDR:3776L21 antisense siNA (3758 C.) inv stab10 | GCAAAAGUCUCACCACCUTsT | 3336 |
| 3893 | CUCACCUGUUUCCUGUAUGGAGG | 2427 | 32996 | KDR:3911L21 antisense siNA (3893 C.) inv stab10 | GUGGACAAAGGACAUACCUTsT | 3337 |
| 2767 | CUUAUGAUGCCAGCAAAUGGGAA | 2218 | 33727 | KDR:2767U21 sense siNA stab07 | B uAuGAuGccAGcAAAuGGGTT | 3338 |
| 2768 | UUAUGAUGCCAGCAAAUGGGAAU | 2222 | 33728 | KDR:2768U21 sense siNA stab07 | B AuGAuGccAGcAAAuGGGATT | 3339 |
| 3715 | AGACCAUGCUGGACUGCUGCACG | 2241 | 33729 | KDR:3715U21 sense siNA stab07 | B AccAuGcuGGAcuGcuGcTT | 3340 |
| 3716 | GACCAUGCUGGACUGCUGCACG | 2247 | 33730 | KDR:3716U21 sense siNA stab07 | B ccAuGcuGGAcuGcuGGcATT | 3341 |
| 2767 | CUUAUGAUGCCAGCAAAUGGGAA | 2218 | 33733 | KDR:2785L21 antisense siNA (2767 C.) stab08 | cccAuuuGcuGGcAucAuATsT | 3342 |
| 2768 | UUAUGAUGCCAGCAAAUGGGAAU | 2222 | 33734 | KDR:2786L21 antisense siNA (2768 C.) stab08 | ucccAuuuGcuGGcAucAuTsT | 3343 |
| 3715 | AGACCAUGCUGGACUGCUGCAC | 2241 | 33735 | KDR:3733L21 antisense siNA (3715 C.) stab08 | GcCAGcAGuccAGcAuGuTsT | 3344 |
| 3716 | GACCAUGCUGGACUGCUGCACG | 2247 | 33736 | KDR:3734L21 antisense siNA (3716 C.) stab08 | uGccAGcAGuccAGcAuGTsT | 3345 |
| 2767 | CUUAUGAUGCCAGCAAAUGGGAA | 2218 | 33739 | KDR:2767U21 sense siNA stab09 | B UAUGAUGCCAGCAAAUGGGUU | 3346 |
| 2768 | UUAUGAUGCCAGCAAAUGGGAAU | 2222 | 33740 | KDR:2768U21 sense siNA stab09 | B AUGAUGCCAGCAAAUGGGAUU | 3347 |
| 3715 | AGACCAUGCUGGACUGCUGCAC | 2241 | 33741 | KDR:3715U21 sense siNA stab09 | B ACCAUGCUGGACUGCUGCUU | 3348 |
| 3716 | GACCAUGCUGGACUGCUGCACG | 2247 | 33742 | KDR:3716U21 sense siNA stab09 | B CCAUGCUGGACUGCUGCAUU | 3349 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 2767 | CUUAUGAUGCCAGCAAAUGGGAA | 2218 | 33745 | KDR:2785L21 antisense siNA (2767 C.) stab10 | CCCAUUUGCUGGCAUCAUAUTsT | 3350 |
| 2768 | UUAUGAUGCCAGCAAAUGGGAAU | 2222 | 33746 | KDR:2786L21 antisense siNA (2768 C.) stab10 | UCCCAUUUGCUGGCAUCAUTsT | 3351 |
| 3715 | AGACCAUGCUGGACUGCUGGCAC | 2241 | 33747 | KDR:3733L21 antisense siNA (3715 C.) stab10 | GCCAGCAGUCCAGCAUGGUTsT | 3352 |
| 3716 | GACCAUGCUGGACUGCUGGCACG | 2247 | 33748 | KDR:3734L21 antisense siNA (3716 C.) stab10 | UGCCAGCAGUCCAGCAUGGTsT | 3353 |
| 2767 | CUUAUGAUGCCAGCAAAUGGGAA | 2218 | 33751 | KDR:2767U21 sense siNA inv stab07 | B GGGuAAAcGAccGuAGuAuTT | 3354 |
| 2768 | UUAUGAUGCCAGCAAAUGGGAAU | 2222 | 33752 | KDR:2768U21 sense siNA inv stab07 | B AGGGuAAAcGAccGuAGuATT | 3355 |
| 3715 | AGACCAUGCUGGACUGCUGGCAC | 2241 | 33753 | KDR:3715U21 sense siNA inv stab07 | B cGGucGucAGGucGuAccATT | 3356 |
| 3716 | GACCAUGCUGGACUGCUGGCACG | 2247 | 33754 | KDR:3716U21 sense siNA inv stab07 | B AcGGucGucAGGucGuAccTT | 3357 |
| 2767 | CUUAUGAUGCCAGCAAAUGGGAA | 2218 | 33757 | KDR:2785L21 antisense siNA (2767 C.) inv stab08 | AuAcuAcGGucGuuuAcccTsT | 3358 |
| 2768 | UUAUGAUGCCAGCAAAUGGGAAU | 2222 | 33758 | KDR:2786L21 antisense siNA (2768 C.) inv stab08 | uAcuAcGGucGuuuAcccuTsT | 3359 |
| 3715 | AGACCAUGCUGGACUGCUGGCAC | 2241 | 33759 | KDR:3733L21 antisense siNA (3715 C.) inv stab08 | uGGuAcGAccuGAcGAccGTsT | 3360 |
| 3716 | GACCAUGCUGGACUGCUGGCACG | 2247 | 33760 | KDR:3734L21 antisense siNA (3716 C.) inv stab08 | GGuAcGAccuGAcGAccGuTsT | 3361 |
| 2767 | CUUAUGAUGCCAGCAAAUGGGAA | 2218 | 33763 | KDR:2767U21 sense siNA inv stab09 | B GGGUAAACGACCGUAGUAUTT | 3362 |
| 2768 | UUAUGAUGCCAGCAAAUGGGAAU | 2222 | 33764 | KDR:2768U21 sense siNA inv stab09 | B AGGGUAAACGACCGUAGUATT | 3363 |
| 3715 | AGACCAUGCUGGACUGCUGGCAC | 2241 | 33765 | KDR:3715U21 sense siNA inv stab09 | B CGGUCGUCAGGUCGUACCATT | 3364 |
| 3716 | GACCAUGCUGGACUGCUGGCACG | 2247 | 33766 | KDR:3716U21 sense siNA inv stab09 | B ACGGUCGUCAGGUCGUACCTT | 3365 |
| 2767 | CUUAUGAUGCCAGCAAAUGGGAA | 2218 | 33769 | KDR:2785L21 antisense siNA (2767 C.) inv stab10 | AUACUACGGUCGUUUACCCTsT | 3366 |
| 2768 | UUAUGAUGCCAGCAAAUGGGAAU | 2222 | 33770 | KDR:2786L21 antisense siNA (2768 C.) inv stab10 | UACUACGGUCGUUUACCCUTsT | 3367 |
| 3715 | AGACCAUGCUGGACUGCUGGCAC | 2241 | 33771 | KDR:3733L21 antisense siNA (3715 C.) inv stab10 | UGGUACGACCUGACGACCGTsT | 3368 |
| 3716 | GACCAUGCUGGACUGCUGGCACG | 2247 | 33772 | KDR:3734L21 antisense siNA (3716 C.) inv stab10 | GGUACGACCUGACGACCGUTsT | 3369 |
| 3715 | AGACCAUGCUGGACUGCUGGCAC | 2241 | 34502 | KDR:3733L21 antisense siNA (3715 C.) stab19 | GccAGcAGuccAGcAuGGuTTB | 3370 |
| 3715 | AGACCAUGCUGGACUGCUGGCAC | 2241 | 34503 | KDR:3733L21 antisense siNA (3715 C.) stab19 | GccAGcAGuccAGcAuGGU | 3371 |
| 3715 | AGACCAUGCUGGACUGCUGGCAC | 2241 | 34504 | KDR:3733L21 antisense siNA (3715 C.) stab08 Blunt | inv | uGGuAc 3372 GAccu GAc GAcc GTTB |
| 3715 | AGACCAUGCUGGACUGCUGGCAC | 2241 | 34505 | KDR:3733L21 anhisense siNA (3715 C.) stab08 Blunt | inv | uGGuAc 3373 GAccu GAc GAccG |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 503 | UCAGAGUGGCAGUGAGCAAAGGG | 2428 | 34680 | KDR:503U21 sense siNA stab00 | AGAGUGGCAGUGAGCAAAGTT | 3374 |
| 503 | UCAGAGUGGCAGUGAGCAAAGGG | 2428 | 34688 | KDR:521L21 (503 C.) siRNA stab00 | CUUUGCUCACUGCCACUCUTT | 3375 |
| 3715 | AGACCAUGCUGGACUGCUGGCAC | 2241 | 35124 | KDR:3715U21 sense siNA stab04 | B AccAuGcuGGAcuGcuGGcCTT B | 3376 |
| 3715 | AGACCAUGCUGGACUGCUGGCAC | 2241 | 35125 | KDR:3715U21 sense siNA stab07 N1 | B AccAuGcuGGAcuGCCUGGCTT B | 3377 |
| 3715 | AGACCAUGCUGGACUGCUGGCAC | 2241 | 35126 | KDR:3733L21 antisense siNA (3715 C.) stab08 N1 | GCCAGCAGuccAGcAuGGuTsT | 3378 |
| 3715 | AGACCAUGCUGGACUGCUGGCAC | 2241 | 35127 | KDR:3733L21 antisense siNA (3715 C.) stab08 N2 | GCcAGcAGuccAGcAuGGuTsT | 3379 |
| 3715 | AGACCAUGCUGGACUGCUGGCAC | 2241 | 35128 | KDR:3733L21 antisense siNA (3715 C.) stab08 N3 | GCCAGcAGuccAGcAuGGuTsT | 3380 |
| 3715 | AGACCAUGCUGGACUGCUGGCAC | 2241 | 35129 | KDR:3733L21 antisense siNA (3715 C.) stab25 | GCCAGcAGuccAGcAuGGuTsT | 3381 |
| 3715 | AGACCAUGCUGGACUGCUGGCAC | 2241 | 35130 | KDR:3733L21 antisense siNA (3715 C.) stab08 N5 | GCcAGcAGuccAGcAuGGuTsT | 3382 |
| 3715 | AGACCAUGCUGGACUGCUGGCAC | 2241 | 35131 | KDR:3733L21 antisense siNA (3715 C.) stab24 | GcAGcAGuccAGcAuGGuTsT | 3383 |
| 83 | CCGCAGAAAGUCCGUCUGGCAGC | 2429 | 36280 | KDR:83U21 sense siNA stab00 | GCAGAAAGUCCGUCUGGCATT | 3384 |
| 84 | CGCAGAAAGUCCGUCUGGCAGCC | 2430 | 36281 | KDR:84U21 sense siNA stab00 | CAGAAAGUCCGUCUGGCAGTT | 3385 |
| 85 | GCAGAAAGUCCGUCUGGCAGCCU | 2431 | 36282 | KDR:85U21 sense siNA stab00 | AGAAAGUCCGUCUGGCAGCTT | 3386 |
| 99 | UGGCAGCCUGGAUAUCCUCUCCU | 2432 | 36283 | KDR:99U21 sense siNA stab00 | GCAGCCUGGAUAUCCUCUCTT | 3387 |
| 100 | GGCAGCCUGGAUAUCCUCUCCUA | 2433 | 36284 | KDR:100U21 sense siNA stab00 | CAGCCUGGAUAUCCUCUCCTT | 3388 |
| 161 | CCGGGCUCCCUAGCCCUGUGCG | 2434 | 36285 | KDR:161U21 sense siNA stab00 | CGGGCUCCCUAGCCCUGUGTT | 3389 |
| 162 | CGGGCUCCCUAGCCCUGUGCGC | 2435 | 36286 | KDR:162U21 sense siNA stab00 | GGGCUCCCUAGCCCUGUGCTT | 3390 |
| 229 | CCUCCUUCUCUAGACAGGCCCUG | 2436 | 36287 | KDR:229U21 sense siNA stab00 | UCCUUCUCUAGACAGGCCCTT | 3391 |
| 230 | CUCCUUCUCUAGACAGGCCCUGG | 2437 | 36288 | KDR:230U21 sense siNA stab00 | CCUUCUCUAGACAGGCCCUTT | 3392 |
| 231 | UCCUUCUCUAGACAGGCCCUGGG | 2438 | 36289 | KDR:231U21 sense siNA stab00 | CUUCUCUAGACAGGCGCUGTT | 3393 |
| 522 | AGGGUGGAGGUGACUGAGUGCAG | 2439 | 36290 | KDR:522U21 sense siNA stab00 | GGUGGAGGUGACUGAGUGCTT | 3394 |
| 523 | GGGUGGAGGUGACUGAGUGCAGC | 2440 | 36291 | KDR:523U21 sense siNA stab00 | GUGGAGGUGACUGAGUGCATT | 3395 |
| 888 | CUGGCAUGGUCUUCUGUGAAGCA | 2441 | 36292 | KDR:888U21 sense siNA stab00 | UGGCAUGGUCUUCUGUGAATT | 3396 |
| 889 | UGGCAUGGUCUUCUGUGAAGCAA | 2442 | 36293 | KDR:889U21 sense siNA stab00 | GGCAUGGUCUUCUGUGAAGTT | 3397 |
| 905 | UGAAGCAAAAAUUAAUGAUGAAA | 2443 | 36294 | KDR:905U21 sense siNA stab00 | AAGCAAAAAUUAAUGAUGATT | 3398 |
| 906 | GAAGCAAAAAUUAAUGAUGAAAG | 2444 | 36295 | KDR:906U21 sense siNA stab00 | AGCAAAAAUUAAUGAUGAATT | 3399 |
| 1249 | CCAAGAACAGCACAUUGUC | 2445 | 36296 | KDR:1249U21 sense siNA stab00 | AAGAAGAACAGCACAUUGTT | 3400 |
| 1260 | AGCACAUUUGUCAGGUCCAUUGA | 2446 | 36297 | KDR:1260U21 sense siNA stab00 | CACAUUUGUCAGGUCCAUTT | 3401 |
| 1305 | AGUGUCAUGGAAUCUCUGUUGGA | 2447 | 36298 | KDR:1305U21 sense siNA stab00 | UGGCAUGGAAUCUCUGGUGTT | 3402 |
| 1315 | AAUCUCUGUUGGAAGCCACGGUG | 2448 | 36299 | KDR:1315U21 sense siNA stab00 | UCUCUGUUGGAAGCCACGTT | 3403 |
| 1541 | GGUCUCUCUGUUGGUGUAUGUCC | 2449 | 36300 | KDR:1541U21 sense siNA stab00 | UCUCUGUUGGUGUAUGUTT | 3404 |
| 1542 | GUCUCUCUGUUGGUGUAUGUCCC | 2450 | 36301 | KDR:1542U21 sense siNA stab00 | CUCUGUUGGUGUAUGUCCTT | 3405 |
| 1588 | UAAUCUCCUGUGGAUCCUAC | 2451 | 36302 | KDR:1588U21 sense siNA stab00 | AUCUCCCUGUGGAUCCUTT | 3406 |
| 1589 | AAUCUCCCUGUGGAUCCUACC | 2452 | 36303 | KDR:1589U21 sense siNA stab00 | UCUCCCUGUGGAUCCUATT | 3407 |
| 1875 | GUGCAGCUUUGUACAAUGUGA | 2453 | 36304 | KDR:1875U21 sense siNA stab00 | GUCAGCUUUGUACAAAUGUTT | 3408 |
| 2874 | GACAAGACAGCAACUUGCAGGACA | 2454 | 36305 | KDR:2874U21 sense siNA stab00 | CAAGACAGCAACUUGCAGGTT | 3409 |
| 2875 | ACAAGACAGCAACUUGCAGGACA | 2455 | 36306 | KDR:2875U21 sense siNA stab00 | AAGACAGCAACUUGCAGGATT | 3410 |
| 2876 | CAAGACAGCAACUUGCAGGACAG | 2456 | 36307 | KDR:2876U21 sense siNA stab00 | AGACAGCAACUUGCAGGACTT | 3411 |
| 3039 | CUCAUGGUGAUUGGUGGAAUCUG | 2457 | 36308 | KDR:3039U21 sense siNA stab00 | CAUGGUGAUUGGUGGAAUCTT | 3412 |
| 3040 | UCAUGGUGAUUGGUGGAAUCUGA | 2458 | 36309 | KDR:3040U21 sense siNA stab00 | AUGGUGAUUGGUGGAAUCUTT | 3413 |
| 3249 | UCCCUCAGUGAUGUAGAAGAAGA | 2459 | 36310 | KDR:3249U21 sense siNA stab00 | CCUCAGUGAUGUAGAAGATT | 3414 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3263 | AGAAGAGGAAGCUCUCUGAAG | 2460 | 36311 | KDR:3263U21 sense siNA stab00 | AAGAGAGGAAGCUCUCUGAUTT | 3415 |
| 3264 | GAAGAGGAAGCUCUCUGAAGA | 2461 | 36312 | KDR:3264U21 sense siNA stab00 | AGAAGAGGAAGCUCCUGAATT | 3416 |
| 3269 | AGGAAGCUCCUGAAGAUCUGU | 2462 | 36313 | KDR:3269U21 sense siNA stab00 | AGGAAGCUCCUGAAGAUCUTT | 3417 |
| 3270 | GGAAGCUCCUGAAGAUCUGUA | 2463 | 36314 | KDR:3270U21 sense siNA stab00 | GGAAGCUCCUGAAGAUCUGTT | 3418 |
| 3346 | AGGGCAUGGAGUCUUGGCAUCG | 2464 | 36315 | KDR:3346U21 sense siNA stab00 | GGCAUGGAGUCUUGGCAUTT | 3419 |
| 3585 | UUGCUGUGGGAAAUAUUUCCCUU | 2465 | 36316 | KDR:3585U21 sense siNA stab00 | GCUGUGGGAAAUAUUUCCUTT | 3420 |
| 3586 | UGCUGUGGGAAAUAUUUCCUUA | 2466 | 36317 | KDR:3586U21 sense siNA stab00 | CUGUGGGAAAUAUUUCCUTT | 3421 |
| 3860 | CAUGGAAGAGGAUUCUGGACUCU | 2467 | 36318 | KDR:3860U21 sense siNA stab00 | UGGAAGAGGAUUCUGGACUTT | 3422 |
| 3877 | GACUCUCUGCCUACCCUCACCU | 2468 | 36319 | KDR:3877U21 sense siNA stab00 | CUCUCUGCCUACCCUCACTT | 3423 |
| 3878 | ACUCUCUGCCUACCCUCACCUG | 2469 | 36320 | KDR:3878U21 sense siNA stab00 | UCUCUCUGCCUACCCUCACCTT | 3424 |
| 4287 | AAGCUGAUAGAGAUUGGAGUGCA | 2470 | 36321 | KDR:4287U21 sense siNA stab00 | GCUGAUAGAGAUUGGAGUGTT | 3425 |
| 4288 | AGCUGAUAGAGAUUGGAGUGCAA | 2471 | 36322 | KDR:4288U21 sense siNA stab00 | GCUGAUAGAGAUUGGAGUGCTT | 3426 |
| 4318 | GCACAGCCCAGAUUCUCCAGCCU | 2472 | 36323 | KDR:4318U21 sense siNA stab00 | ACAGCCCAGAUUCUCCAGCTT | 3427 |
| 4319 | CACAGCCCAGAUUCUCCAGCCUG | 2473 | 36324 | KDR:4319U21 sense siNA stab00 | CAGCCCAGAUUCUCCAGCCTT | 3428 |
| 4320 | ACAGCCCAGAUUCUCCAGCCUGA | 2474 | 36325 | KDR:4320U21 sense siNA stab00 | AGCCCAGAUUCUCCAGCCUTT | 3429 |
| 4321 | CAGCCCAGAUUCUCCAGCCUGAC | 2475 | 36326 | KDR:4321U21 sense siNA stab00 | GCCCAGAUUCUCCAGCCUGTT | 3430 |
| 4359 | AGUCUCCUGUUUAAAAGGA | 2476 | 36327 | KDR:4359U21 sense siNA stab00 | CUCUCCUGUUUAAAAGTT | 3431 |
| 4534 | UAUCCUGGAAGAGGCUUGUGACC | 2477 | 36328 | KDR:4534U21 sense siNA stab00 | UCCUGGAAGAGGCUUGUGATT | 3432 |
| 4535 | AUCCUGGAAGAGGCUUGUGACCC | 2478 | 36329 | KDR:4535U21 sense siNA stab00 | CCUGGAAGAGGCUUGUGACTT | 3433 |
| 4536 | UCCUGGAAGAGGCUUGUGACCCA | 2479 | 36330 | KDR:4536U21 sense siNA stab00 | CUGGAAGAGGCUUGUGACCTT | 3434 |
| 4539 | UGGAAGAGGCUUGUGACCCAAGA | 2480 | 36331 | KDR:4539U21 sense siNA stab00 | GAAGAGGCUUGUGACCCAATT | 3435 |
| 4769 | UGUGAAGAUGGAAGGAUUUGC | 2481 | 36332 | KDR:4769U21 sense siNA stab00 | UUGAAGAUGGAAGGAUUUTT | 3436 |
| 4934 | UCUGGAGGUGGGCAUGGGGU | 2482 | 36333 | KDR:4934U21 sense siNA stab00 | UGGUGGAGGUGGGCAUGGGTT | 3437 |
| 5038 | UCGGUGCUGUUCUGACUCCU | 2483 | 36334 | KDR:5038U21 sense siNA stab00 | GUGUGCUGUUCUGACUCCTT | 3438 |
| 5039 | CGUGUGCUGUUCUGACUCCUA | 2484 | 36335 | KDR:5039U21 sense siNA stab00 | UGUGCUGUUCUGACUCCUTT | 3439 |
| 5040 | GUGUGCUGUUCUGACUCCUAA | 2485 | 36336 | KDR:5040U21 sense siNA stab00 | UGUGCUGUUCUGACUCCUUTT | 3440 |
| 5331 | UCAAAGUUCAGGAAGGAUUUUA | 2486 | 36337 | KDR:5331U21 sense siNA stab00 | AAAGUUCAGGAAGGAUUUUTT | 3441 |
| 5332 | CAAAGUUCAGGAAGGAUUUUAC | 2487 | 36338 | KDR:5332U21 sense siNA stab00 | AAGUUCAGGAAGGAUUUUATT | 3442 |
| 5333 | AAAGUUCAGGAAGGAUUUUACC | 2488 | 36339 | KDR:5333U21 sense siNA stab00 | AGUUCAGGAAGGAUUUUATT | 3443 |
| 5587 | UCAAAAAGAAAAUGUGUUUUU | 2489 | 36340 | KDR:5587U21 sense siNA stab00 | AAAAAGAAAAUGUGUUUUTT | 3444 |
| 5737 | CUAAUUCACAUUUUGUAUCAGUU | 2490 | 36341 | KDR:5737U21 sense siNA stab00 | AAUUCACAUUUUGUAUCAGUTT | 3445 |
| 5738 | UAUUCACAUUUUGUAUCAGUAU | 2491 | 36342 | KDR:5738U21 sense siNA stab00 | AUUCACAUUUUGUAUCAGUATT | 3446 |
| 5739 | AUUCACAUUUUGUAUCAGUAUU | 2492 | 36343 | KDR:5739U21 sense siNA stab00 | UCACAUUUUGUAUCAGUAUTT | 3447 |
| 83 | CCGAGAACCGUCCGGCAGC | 2429 | 36344 | KDR:101L21 antisense siNA (83 C.) stab00 | UGCCAGACGACUUUCUGCTT | 3448 |
| 84 | CGAGAACCGUCCGGCAGCC | 2430 | 36345 | KDR:102L21 antisense siNA (84 C.) stab00 | CUGCCAGACGACUUUCUGUTT | 3449 |
| 85 | GCAGAAAGUCCGUCCGGCAGCCU | 2431 | 36346 | KDR:103L21 antisense siNA (85 C.) stab00 | GCUGCCAGACGGACUUUCUTT | 3450 |
| 99 | UGGCAGCCGGAUACCUCUCCU | 2432 | 36347 | KDR:117L21 antisense siNA (99 C.) stab00 | GAGAGGAUAUCCAGGCUGCTT | 3451 |
| 100 | GGCAGCCGGAUACCUCUCCUA | 2433 | 36348 | KDR:118L21 antisense siNA (100 C.) stab00 | GAGAGGAUAUCCAGGCUGTT | 3452 |
| 161 | CCCGGCUCCCUAGCCCUGCG | 2434 | 36349 | KDR:179L21 antisense siNA (161 C.) stab00 | CACAGGGCUAGGGAGCCCGTT | 3453 |
| 162 | CCGGGCUCCCUAGCCCUGCGC | 2435 | 36350 | KDR:180L21 antisense siNA (162 C.) stab00 | GCACAGGGCUAGGGAGCCCTT | 3454 |
| 229 | CCCCUUCUCUAGACAGGCGCUG | 2436 | 36351 | KDR:247L21 antisense siNA (229 C.) stab00 | GCGCCUGUCUAGAGAAGGATT | 3455 |
| 230 | CCCUUCUCUAGACAGGCGCUGG | 2437 | 36352 | KDR:248L21 antisense siNA (230 C.) stab00 | AGCCUGUCUAGAGAAGAAGTT | 3456 |
| 231 | UCCUUCUCUAGACAGGCGCUGGG | 2438 | 36353 | KDR:249L21 antisense siNA (231 C.) stab00 | CAGCCUGUCUAGAGAAGAAGTT | 3457 |
| 522 | AGGGUGGAGGUGACUGAGUGCAG | 2439 | 36354 | KDR:540L21 antisense siNA (522 C.) stab00 | GCACUCAGUCACCUCCACCTT | 3458 |
| 523 | GGGUGGAGGUGACUGAGUGCAGC | 2440 | 36355 | KDR:541L21 antisense siNA (523 C.) stab00 | UGCACUCAGUCACCUCCACTT | 3459 |
| 888 | CUGGCAUGGCAUGUCCUCUGUGAAGC | 2441 | 36356 | KDR:906L21 antisense siNA (888 C.) stab00 | UUCACAGAAGACCAUGCCATT | 3460 |
| 889 | CUGGCAUGGCAUGUCUUCUGUGAAGCA | 2442 | 36357 | KDR:907L21 antisense siNA (889 C.) stab00 | CUUCACAGAAGACCAUGCCTT | 3461 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 905 | UGAAGCAAAAAUUAAUGAUGAAA | 2443 | 36358 | KDR:923L21 antisense siNA (905 C.) stab00 | UCAUCAUUAAUUUUGCUUTT | 3462 |
| 906 | GAAGCAAAAAUUAAUGAUGAAAG | 2444 | 36359 | KDR:924L21 antisense siNA (906 C.) stab00 | UUCAUCAUUAAUUUUGCUTT | 3463 |
| 1249 | CCAAGAGAACAGCACAUUUGUC | 2445 | 36360 | KDR:1267L21 antisense siNA (1249 C.) stab00 | CAAAUGUGCUGUCUUCUCUTT | 3464 |
| 126 | CAGCACAUUUGUCAGGGUCCAUGA | 2446 | 36361 | KDR:1278L21 antisense siNA (1260 C.) stab00 | AUGGACCCUGACAAAUGUGTT | 3465 |
| 1305 | AGUGGCAUGGAAUCUCUGGUGA | 2447 | 36362 | KDR:1323L21 antisense siNA (1305 C.) stab00 | CACCAGAGAUUCCAUGCCATT | 3466 |
| 1315 | AAUCUCUGGUGGAAGCCACGGUG | 2448 | 36363 | KDR:1333L21 antisense siNA (1315 C.) stab00 | CCGUGGCUUCCACCAGAGATT | 3467 |
| 1541 | GGUCUCUCUGGUUGUGUAUGUCC | 2449 | 36364 | KDR:1559L21 antisense siNA (1541 C.) stab00 | ACAUACACAACCAGAGAGATT | 3468 |
| 1542 | GUCUCUCUGGUUGUGUAUGUCCC | 2450 | 36365 | KDR:1560L21 antisense siNA (1542 C.) stab00 | GACAUACACAACCAGAGAGTT | 3469 |
| 1588 | UAAUCUCUCCUGUGGAUUCCUAC | 2451 | 36366 | KDR:1606L21 antisense siNA (1588 C.) stab00 | AGGAAUCCACAGGAGAGAUTT | 3470 |
| 1589 | AAUCUCUCCUGUGGAUUCCUACC | 2452 | 36367 | KDR:1607L21 antisense siNA (1589 C.) stab00 | UAGGAAUCCACAGGAGAGATT | 3471 |
| 1875 | GUGUCAGCUUUGUACAAAUGUGA | 2453 | 36368 | KDR:1893L21 antisense siNA (1875 C.) stab00 | ACAUUUGUACAAAGCUGACTT | 3472 |
| 2874 | GACAAGACAGCAACUUGCAGGAC | 2454 | 36369 | KDR:2892L21 antisense siNA (2874 C.) stab00 | CCUGCAAGUUGCUGUCUUGTT | 3473 |
| 2875 | ACAAGACAGCAACUUGCAGGACA | 2455 | 36370 | KDR:2893L21 antisense siNA (2875 C.) stab00 | UCCUGCAAGUUGCUGUCUUTT | 3474 |
| 2876 | CAAGACAGCAACUUGCAGGACAG | 2456 | 36371 | KDR:2894L21 antisense siNA (2876 C.) stab00 | GUCCUGCAAGUUGCUGUCUTT | 3475 |
| 3039 | CUCAUGGUGAUUGGUGGAAUUGC | 2457 | 36372 | KDR:3057L21 antisense siNA (3039 C.) stab00 | GAAUUCCACAAUCACCAUGTT | 3476 |
| 3040 | UCAUGGUGAUUGGUGGAAUUGCA | 2458 | 36373 | KDR:3058L21 antisense siNA (3040 C.) stab00 | AGAAUUCCACAAUCACCAUTT | 3477 |
| 3249 | UCCCUCAGUGAUGAGUAGAAGAA | 2459 | 36374 | KDR:3267L21 antisense siNA (3249 C.) stab00 | UUCUUCUACAUCACUGAGGTT | 3478 |
| 3263 | AGAAGAAGGAAGCUCCUGAAG | 2460 | 36375 | KDR:3281L21 antisense siNA (3263 C.) stab00 | UCAGGAGCUUCCUUCUUCUTT | 3479 |
| 3264 | GAAGAAGGAAGCUCCUGAAGA | 2461 | 36376 | KDR:3282L21 antisense siNA (3264 C.) stab00 | UUCAGGAGCUUCCUUCUUCTT | 3480 |
| 3269 | AGGAAGCUCCUGAAGAUCUGU | 2462 | 36377 | KDR:3287L21 antisense siNA (3269 C.) stab00 | AGAUCUUCAGGAGCUUCCTT | 3481 |
| 3270 | GGAAGCUCCUGAAGAUCUGUA | 2463 | 36378 | KDR:3288L21 antisense siNA (3270 C.) stab00 | CAGAUCUUCAGGAGCUUCCTT | 3482 |
| 3346 | AGGGCAUGGAGUUCUUGGCAUCG | 2464 | 36379 | KDR:3364L21 antisense siNA (3346 C.) stab00 | AUGCCAAGAACUCCAUGCCTT | 3483 |
| 3585 | UUGCUGUGGGAAAUAUUUUCCUU | 2465 | 36380 | KDR:3603L21 antisense siNA (3585 C.) stab00 | GGAAAAUAUUUCCCACAGCTT | 3484 |
| 3586 | UGCUGUGGGAAAUAUUUUCCUUA | 2466 | 36381 | KDR:3604L21 antisense siNA (3586 C.) stab00 | AGGAAAAUAUUUCCCACAGTT | 3485 |
| 3860 | CAUGGAAGAGGAUUCCUGACUCU | 2467 | 36382 | KDR:3878L21 antisense siNA (3860 C.) stab00 | AGUCCAGAAUCCUCUUCCATT | 3486 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3877 | GACUCUCUGCUGCCUUACCUCACCU | 2468 | 36383 | KDR:3895L21 antisense siNA (3877 C.) stab00 | GUGAGGUAGGCAGAGAGAGUU | 3487 |
| 3878 | ACUCUCUGCUGCCUUACCUCACCUG | 2469 | 36384 | KDR:3896L21 antisense siNA (3878 C.) stab00 | GGUGAGGUAGGCAGAGAGAUU | 3488 |
| 4287 | AAGCUGAUAGAGAGAUUGGAGUGCA | 2470 | 36385 | KDR:4305L21 antisense siNA (4287 C.) stab00 | CACUCCAAUCUCUAUCAGCUU | 3489 |
| 4288 | AGCUGAUAGAGAGAUUGGAGUGCAA | 2471 | 36386 | KDR:4306L21 antisense siNA (4288 C.) stab00 | GCACUCCAAUCUCUAUCAGUU | 3490 |
| 4318 | GCACAGCCCAGAUUCUCCAGCCU | 2472 | 36387 | KDR:4336L21 antisense siNA (4318 C.) stab00 | GCUGGAGAAUCUGGGCUGUUU | 3491 |
| 4319 | CACAGCCCAGAUUCUCCAGCCUG | 2473 | 36388 | KDR:4337L21 antisense siNA (4319 C.) stab00 | GGCUGGAGAAUCUGGGCUGUU | 3492 |
| 4320 | ACAGCCCAGAUUCUCCAGCCUGA | 2474 | 36389 | KDR:4338L21 antisense siNA (4320 C.) stab00 | AGGCUGGAGAAUCUGGGCUUU | 3493 |
| 4321 | CAGCCCAGAUUCUCCAGCCUGAC | 2475 | 36390 | KDR:4339L21 antisense siNA (4321 C.) stab00 | CAGGCUGGAGAAUCUGGGCUU | 3494 |
| 4359 | AGCUCCUCCUGUUUAAAAGGA | 2476 | 36391 | KDR:4377L21 antisense siNA (4359 C.) stab00 | CUUUUAAACAGGAGGAGAGUU | 3495 |
| 4534 | UAUCCUGGAAGAGGCUUGUGUGACC | 2477 | 36392 | KDR:4552L21 antisense siNA (4534 C.) stab00 | UCACAAGCCUCUUCCAGGAUU | 3496 |
| 4535 | AUCCUGGAAGAGGCUUGUGUGACCC | 2478 | 36393 | KDR:4553L21 antisense siNA (4535 C.) stab00 | GUCACAAGCCUCUUCCAGGUU | 3497 |
| 4536 | UCCUGGAAGAGGCUUGUGUGACCCA | 2479 | 36394 | KDR:4554L21 antisense siNA (4536 C.) stab00 | GGUCACAAGCCUCUUCCAGUU | 3498 |
| 4539 | UGGAAGAGGCUUGUGUGACCCAAGA | 2480 | 36395 | KDR:4557L21 antisense siNA (4539 C.) stab00 | UUGGGUCACAAGCCUCUCUU | 3499 |
| 4769 | UGUUGAAGAUGGAAGAGGAUUUGC | 2481 | 36396 | KDR:4787L21 antisense siNA (4769 C.) stab00 | AAAUCCUCCUCCAUCUUCAUU | 3500 |
| 4934 | UCUGGUGAGGUGGGCAUGGGGU | 2482 | 36397 | KDR:4952L21 antisense siNA (4934 C.) stab00 | CCCAUGCCCACCUCCACCAUU | 3501 |
| 5038 | UCGUUGUGCUGUUUCUGACUCCU | 2483 | 36398 | KDR:5056L21 antisense siNA (5038 C.) stab00 | GAGUCAGAAACAGCACAACUU | 3502 |
| 5039 | CGUUGUGCUGUUUCUGACUCCUA | 2484 | 36399 | KDR:5057L21 antisense siNA (5039 C.) stab00 | GGAGUCAGAAACAGCACACUU | 3503 |
| 5040 | GUUGUGCUGUUUCUGACUCCUAA | 2485 | 36400 | KDR:5058L21 antisense siNA (5040 C.) stab00 | AGGAGUCAGAAACAGCACAUU | 3504 |
| 5331 | UCAAAGUUUCAGGAAGGAUUUUA | 2486 | 36401 | KDR:5349L21 antisense siNA (5331 C.) stab00 | AAAUCCUUCCUGAAACUUUUU | 3505 |
| 5332 | CAAAGUUUCAGGAAGGAUUUUAC | 2487 | 36402 | KDR:5350L21 antisense siNA (5332 C.) stab00 | AAAAUCCUUCCUGAAACUUUU | 3506 |
| 5333 | AAAGUUUCAGGAAGGAUUUUACC | 2488 | 36403 | KDR:5351L21 antisense siNA (5333 C.) stab00 | UAAAAUCCUUCCUGAAACUUU | 3507 |
| 5587 | UCAAAAAGAAAAAUGUGUUUUU | 2489 | 36404 | KDR:5605L21 antisense siNA (5587 C.) stab00 | AAAACACAAUUUUCUUUUUUU | 3508 |
| 5737 | CUAUUCACAUUUUGUAUCAGUAU | 2490 | 36405 | KDR:5755L21 antisense siNA (5737 C.) stab00 | ACUGAUACAAAAUGUGAAUUU | 3509 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 5738 | UAUUCACAUUUGUAUCAGUAUU | 2491 | 36406 | KDR:5756L21 antisense siNA (5738 C.) stab00 | UACUGAUACAAAUGUGAAUU | 3510 |
| 5739 | AUUCACAUUUGUAUCAGUAUUA | 2492 | 36407 | KDR:5757L21 antisense siNA (5739 C.) stab00 | AUACUGAUACAAAUGUGAUU | 3511 |
| 359 | GGCGCCUCUGUGGGGUUUGCCUA | 2493 | 37460 | KDR:359U21 sense siNA stab07 | B cGCccucGuGGGuuuGccTT B | 3512 |
| 360 | GCCGCCUCUGUGGGGUUUGCCUAG | 2494 | 37461 | KDR:360U21 sense siNA stab07 | B cGccucuGuGGGuuuGccuTT B | 3513 |
| 799 | ACCCAGAAAGAGAUUGUUCCU | 2495 | 37462 | KDR:799U21 sense siNA stab07 | B ccAGAAAGAGAuuuGuucTT B | 3514 |
| 826 | GUAACAGAAUUUCCGGGACAGC | 2496 | 37463 | KDR:826U21 sense siNA stab07 | B AAcAGAAuuuccGGGAcATT B | 3515 |
| 1027 | AGCUUGUCUUAAAUUGUACAGCA | 2497 | 37464 | KDR:1027U21 sense siNA stab07 | B cuuGucuuAAAuuGuAcAGTT B | 3516 |
| 1827 | GAAGGAAAAAACAAAACUGUAAG | 2498 | 37465 | KDR:1827U21 sense siNA stab07 | B AGGAAAAAAcAAAAcuGuATT B | 3517 |
| 1828 | AAGGAAAAAACAAAACUGUAAGU | 2499 | 37466 | KDR:1828U21 sense siNA stab07 | B GGAAAAAAcAAAAcuGuAATT B | 3518 |
| 1947 | ACCAGGGGUCCUGAAAUUACUUU | 2500 | 37467 | KDR:1947U21 sense siNA stab07 | B cAGGGGuccuGAAAuuAcuTT B | 3519 |
| 2247 | AAGACCAAGAAAAGACAUUGCGU | 2501 | 37468 | KDR:2224U21 sense siNA stab07 | B GAccAAGAAAAGAcAuuGcTT B | 3520 |
| 2501 | AGGCUCUACACCUGCCAGGCAU | 2502 | 37469 | KDR:2501U21 sense siNA stab07 | B GccucuAcAccuGccAGcTT B | 3521 |
| 2624 | GAUUGCCAUGUCUCUCGGCUAC | 2503 | 37470 | KDR:2624U21 sense siNA stab07 | B uuGccAuGucucucGGcuTT B | 3522 |
| 2685 | GGAGGGAACUGAAGACAGGCUA | 2504 | 37471 | KDR:2685U21 sense siNA stab07 | B AGGGGAAcuGAAGAcAGGcTT B | 3523 |
| 2688 | GGGAACUGAAGACAGGCUACUU | 2505 | 37472 | KDR:2688U21 sense siNA stab07 | B GGAAcuGAAGAcAGGcuAcTT B | 3524 |
| 2689 | GGAACUGAAGACAGGCUACUUG | 2506 | 37473 | KDR:2689U21 sense siNA stab07 | B GAAcuGAAGAcAGGcuAcuTT B | 3525 |
| 2690 | GAACUGAAGACAGGCUACUUGU | 2507 | 37474 | KDR:2690U21 sense siNA stab07 | B AAcuGAAGAcAGGcuAcuuTT B | 3526 |
| 2692 | ACUGAAGACAGGCUACUUGUCC | 2508 | 37475 | KDR:2692U21 sense siNA stab07 | B cuGAAGAcAGGcuAcuuGuTT B | 3527 |
| 2762 | ACUGCCCUAUGAUGCCAGCAAAU | 2509 | 37476 | KDR:2762U21 sense siNA stab07 | B uGcccuAuGAuGccAGcAATT B | 3528 |
| 3187 | GGCCAUCUUCCUGACAUCACAGU | 2510 | 37477 | KDR:3187U21 sense siNA stab07 | B cccuuGGAcAGcAucAccATT B | 3529 |
| 3293 | UAAGGACUUCCUGACCUGGAGC | 2511 | 37478 | KDR:3293U21 sense siNA stab07 | B AGGAcuuccuGAccuGGATT B | 3530 |
| 3306 | ACCUUGGAGCAUCUCAUCUGUA | 2512 | 37479 | KDR:3306U21 sense siNA stab07 | B cuuGGAcAucucAucuGuATT B | 3531 |
| 3308 | CUUGGAGCAUCUCAUCUGUUACA | 2513 | 37480 | KDR:3308U21 sense siNA stab07 | B uGGAGcAucucAucuGuuATT B | 3532 |
| 3309 | UUGGAGCAUCUCAUCUGUUACAG | 2514 | 37481 | KDR:3309U21 sense siNA stab07 | B GGAGcAucucAucuGuuAcTT B | 3533 |
| 3312 | GAGCAUCUCAUCUGUUACAGCUU | 2515 | 37482 | KDR:3312U21 sense siNA stab07 | B GcAucucAucuGuuAcAGcTT B | 3534 |
| 3320 | CAUCUGUUACAGCUUCCAAGUGG | 2516 | 37483 | KDR:3320U21 sense siNA stab07 | B ucuGuuAcAGcuuccAAGuTT B | 3535 |
| 3324 | UGUUACAGCUUCCAAGUGGCUAA | 2517 | 37484 | KDR:3324U21 sense siNA stab07 | B uuAcAGcuuccAAGuGGcuTT B | 3536 |
| 3334 | UCCAAGUGGCUAAGGGCAUGGAG | 2518 | 37485 | KDR:3334U21 sense siNA stab07 | B cAAGuGGcuAAGGGcAuGGTT B | 3537 |
| 3346 | AGGGCAUGGAGUUCUUGGCAUCG | 2519 | 37486 | KDR:3346U21 sense siNA stab07 | B GGcAuGGAGuucuuGGcATT B | 3538 |
| 3347 | GGGCAUGGAGUUCUUGGCAUCGC | 2464 | 37487 | KDR:3347U21 sense siNA stab07 | B GcAuGGAGuucuuGGcAucTT B | 3539 |
| 3857 | AGCAUGGAGUAGAGAGAUUCGGAC | 2520 | 37488 | KDR:3857U21 sense siNA stab07 | B uuAcAGcuuccAAGuGGcuTT B | 3540 |
| 3858 | AGGAAGGAAGAGAGAUUCGGACU | 2521 | 37489 | KDR:3858U21 sense siNA stab07 | B CAuGGAAGAGAGAuucuGGATT B | 3541 |
| 3860 | CAUGGAAGAGAGAUUCGGACUCU | 2467 | 37490 | KDR:3860U21 sense siNA stab07 | B uGGAAGAGAGAuucuGGAcuTT B | 3542 |
| 3883 | CUCGCCUACCUCACCUGUUUCC | 2522 | 37491 | KDR:3883U21 sense siNA stab07 | B cuGccuAccucAccuGuuuTT B | 3543 |
| 3884 | UCUGCCUACCUCACCUGUUUCCU | 2523 | 37492 | KDR:3884U21 sense siNA stab07 | B uGccuAccucAccuGuuucTT B | 3544 |
| 3885 | CUGCCUACCUCACCUGUUUCCUG | 2524 | 37493 | KDR:3885U21 sense siNA stab07 | B GccuAccucAccuGuuuccTT B | 3545 |
| 3892 | CCUACCUGUUUCCUGUAUGGAG | 2525 | 37494 | KDR:3892U21 sense siNA stab07 | B ucAccuGuuuccuGuAuGGTT B | 3546 |
| 3936 | AAAUUCCAUUAUGACAACACAGC | 2526 | 37495 | KDR:3936U21 sense siNA stab07 | B AuuccAuuAuGAcAAcAcATT B | 3547 |
| 3940 | UCCAUUAUGACAACACAGCAGGA | 2527 | 37496 | KDR:3940U21 sense siNA stab07 | B cAuuAuGAcAAcAcAGcAGTT B | 3548 |
| 359 | GGCCGCCUCUGUGGGGUUUGCCUA | 2493 | 37497 | KDR:377L21 antisense siNA (359 C.) stab26 | GGCAAAcccAcAGAGGcGuTT | 3549 |
| 360 | GCCGCCUCUGUGGGGUUUGCCUAG | 2494 | 37498 | KDR:378L21 antisense siNA (360 C.) stab26 | AGGcAAAcccAcAGAGGcGTT | 3550 |
| 799 | ACCCAGAAAGAGAUUGUUCCU | 2495 | 37499 | KDR:817L21 antisense siNA (799 C.) stab26 | GAAcAAAucucuuuucuGGTT | 3551 |
| 826 | GUAACAGAAUUUCCGGGACAGC | 2496 | 37500 | KDR:844L21 antisense siNA (826 C.) stab26 | UGUcccAGGAAAuucuGuuTT | 3552 |
| 1027 | AGCUUGUCUUAAAUUGUACAGCA | 2497 | 37501 | KDR:1045L21 antisense siNA (1027 C.) stab26 | CUGuAcAAuuuAAGAcAAGTT | 3553 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1827 | GAAGGAAAAACAAAACUGUAAG | 2498 | 37502 | KDR:1845L21 antisense siNA (1827 C.) stab26 | UACAGuuuuGuuuuuccuTT | 3554 |
| 1828 | AAGGAAAAACAAAACUGUAAGU | 2499 | 37503 | KDR:1846L21 antisense siNA (1828 C.) stab26 | UUAcAGuuuuGuuuuuccTT | 3555 |
| 1947 | ACCAGGGGUCCUGAAAUUACUUU | 2500 | 37504 | KDR:1965L21 antisense siNA (1947 C.) stab26 | AGUAAuucAGGAcccuGTT | 3556 |
| 2247 | AAGACCAAGAAAAGACAUUGCGU | 2501 | 37505 | KDR:2265L21 antisense siNA (2247 C.) stab26 | GCAAuGucuuuuucuuGGucTT | 3557 |
| 2501 | AGGCCUCUACACCUGCCAGGCAU | 2502 | 37506 | KDR:2519L21 antisense siNA (2501 C.) stab26 | GCCuGGcAGGuGuAGAGGcTT | 3558 |
| 2624 | GAUUGCCAUGUUCUUCUGGCUAC | 2503 | 37507 | KDR:2642L21 antisense siNA (2624 C.) stab26 | AGCcAGAAGAAAuGGcAATT | 3559 |
| 2685 | GGAGGGGAACUGAAGACAGGCUA | 2504 | 37508 | KDR:2703L21 antisense siNA (2685 C.) stab26 | GCCuGcuucAGuccccuTT | 3560 |
| 2688 | GGGAACUGAAGACAGGCUACUU | 2505 | 37509 | KDR:2706L21 antisense siNA (2688 C.) stab26 | GUAGccuGucuucAGuccTT | 3561 |
| 2689 | GGAACUGAAGACAGGCUACUUG | 2506 | 37510 | KDR:2707L21 antisense siNA (2689 C.) stab26 | AGUAGccuGucuucAGuuTT | 3562 |
| 2690 | GAACUGAAGACAGGCUACUUGU | 2507 | 37511 | KDR:2708L21 antisense siNA (2690 C.) stab26 | AAGuAGccuGucuucAGuuTT | 3563 |
| 2692 | ACUGAAGACAGGCUACUUGUCC | 2508 | 37512 | KDR:2710L21 antisense siNA (2692 C.) stab26 | ACAAGuAGccuGucuucAGTT | 3564 |
| 2762 | ACUGCCCUUAUGAUGCCAGCAAU | 2509 | 37513 | KDR:2780L21 antisense siNA (2762 C.) stab26 | UUGcuGGcAucAuAAGGcATT | 3565 |
| 3187 | GGCCUCCUGGACAGCAUCACCAGU | 2510 | 37514 | KDR:3205L21 antisense siNA (3187 C.) stab26 | UGGuGAuGcuGucCAAGcGTT | 3566 |
| 3293 | UAAGGACUUCCUGACCUUGGAGC | 2511 | 37515 | KDR:3311L21 antisense siNA (3293 C.) stab26 | UCCAAGGucAGGAAGucccuTT | 3567 |
| 3306 | ACCUUGGAGCAUCUCAUCUGUUA | 2512 | 37516 | KDR:3324L21 anhisense siNA (3306 C.) stab26 | ACACAGAuGAGAuGcuccAAGTT | 3568 |
| 3308 | CUUGGAGCAUCUCAUCUGUUACA | 2513 | 37517 | KDR:3326L21 antisense siNA (3308 C.) stab26 | UAAcAGAuGAGAuGcuccATT | 3569 |
| 3309 | UUGGAGCAUCUCAUCUGUUACAG | 2514 | 37518 | KDR:3327L21 antisense siNA (3309 C.) stab26 | GUAAcAGAuGAGAuGcuccTT | 3570 |
| 3312 | GAGCAUCUCAUCUGUUACAGCUU | 2515 | 37519 | KDR:3330L21 antisense siNA (3312 C.) stab26 | GCUGuAAcAGAuGAGAuGcTT | 3571 |
| 3320 | CAUCUGUUACAGCUUCCAAGUGG | 2516 | 37520 | KDR:3338L21 antisense siNA (3320 C.) stab26 | ACUuGGAAGcuGuAAcAGATT | 3572 |
| 3324 | UGUUACAGCUUCCAAGUGGCUAA | 2517 | 37521 | KDR:3342L21 antisense siNA (3324 C.) stab26 | AGCcAcuuGGAAGcuGuAATT | 3573 |
| 3334 | UCCAAGUGGCUUCAAGGGCAUGGAG | 2518 | 37522 | KDR:3352L21 antisense siNA (3334 C.) stab26 | CCAuGcccuuAGccAcuuGTT | 3574 |
| 3346 | AGGGCAUGGAGUUCUUGGCAUCG | 2464 | 37523 | KDR:3364L21 antisense siNA (3346 C.) stab26 | AUGccAAGAAcuccAuGccTT | 3575 |
| 3347 | GGGCAUGGAGUUCUUGGCAUCGC | 2519 | 37524 | KDR:3365L21 antisense siNA (3347 C.) stab26 | GAUGccAAGAAcuccAuGcTT | 3576 |
| 3758 | CACGUUUCAGAGUUGGUGGAAAC | 2426 | 37525 | KDR:3776L21 antisense siNA (3758 C.) stab26 | UCCAccAAcucuGAAAAcGTT | 3577 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3857 | GAGCAUGGAAGAGGAUUCUGGAC | 2520 | 37526 | KDR:3875L21 antisense siNA (3857 C.) stab26 | CCAGAAuccucuccAuGcTT | 3578 |
| 3858 | AGCAUGGAAGAGGAUUCUGGACU | 2521 | 37527 | KDR:3876L21 antisense siNA (3858 C.) stab26 | UCCAGAAuccucuccAUgTT | 3579 |
| 3860 | CAUGGAAGAGGAUUCUGGACUCU | 2467 | 37528 | KDR:3878L21 antisense siNA (3860 C.) stab26 | AGUcCAGAAuccucuccATT | 3580 |
| 3883 | CUCUGCCUACCUCACCUGUUUCC | 2522 | 37529 | KDR:3901L21 antisense siNA (3883 C.) stab26 | AAAcAGGuGAGGuAGGcAGTT | 3581 |
| 3884 | UCUGCCUACCUCACCUGUUUCCU | 2523 | 37530 | KDR:3902L21 antisense siNA (3884 C.) stab26 | GAAAcAGGuGAGGuAGGcATT | 3582 |
| 3885 | CUGCCUACCUCACCUGUUUCCUG | 2524 | 37531 | KDR:3903L21 antisense siNA (3885 C.) stab26 | GGAAAcAGGuGAGGuAGGcTT | 3583 |
| 3892 | CCUCACCUGUUUCCUGUAUGGAG | 2525 | 37532 | KDR:3910L21 antisense siNA (3892 C.) stab26 | CCAuAcAGGAAAcAGGuGATT | 3584 |
| 3893 | CUCACCUGUUUCCUGUAUGGAGG | 2427 | 37533 | KDR:3911L21 antisense siNA (3893 C.) stab26 | UCCAuAcAGGAAAcAGGuGTT | 3585 |
| 3936 | AAAUUCCAUUAUGACAACACAGC | 2526 | 37534 | KDR:3954L21 antisense siNA (3936 C.) stab26 | UGUGuuGucAuAAuGGAAuTT | 3586 |
| 3940 | UCCAUUAUGACAACACAGCAGGA | 2527 | 37535 | KDR:3958L21 antisense siNA (3940 C.) stab26 | CUGcuGuGuuGucAuAAuGTT | 3587 |
| 3948 | GACAACACAGCAGGAAUCAGUCA | 2408 | 37536 | KDR:3966L21 antisense siNA (3948 C.) stab26 | ACUGAuuccuGcuGuGuuGTT | 3588 |

VEGFR3

| Target Pos | Target | Seq ID | Cmpd # | Aliases | Sequence | Seq ID |
|---|---|---|---|---|---|---|
| 2011 | AGCACUGCCACAAGAAGUACCUG | 2528 | 31904 | FLT4:2011U21 sense siNA | CACUGCCAAGAAGAGUACCUTT | 3589 |
| 3921 | CUGAAGCAGAGAGGACAAGA | 2529 | | FLT4:3921U21 sense siNA | GAAGCAGAGAGGAGAAGGTT | 3590 |
| 4038 | AAAGAGGAACCAGGAGGACAAGA | 2530 | | FLT4:4038U21 sense siNA | AGAGGAACCAGGAGGACAATT | 3591 |
| 4054 | GACAAGAGGAGCAUGAAAGUGGA | 2531 | | FLT4:4054U21 sense siNA | CAAGAGGACCAUGAAAGUGTT | 3592 |
| 2011 | AGCACUGCCACAAGAAGUACCUG | 2528 | 31908 | FLT4:2029L21 antisense siNA (2011 C.) | GGUACUUCUUGUGGCAGUGTT | 3593 |
| 3921 | CUGAAGCAGAGAGGACAAGGCA | 2529 | | FLT4:3939L21 antisense siNA (3921 C.) | CCUUCUCCUCUCUGCUCUTT | 3594 |
| 4038 | AAAGAGGAACCAGGAGGACAAGA | 2530 | | FLT4:4056L21 antisense siNA (4038 C.) | UUGUCCUCCUGGUUCCUCUTT | 3595 |
| 4054 | GACAAGAGGAGCAUGAAAGUGGA | 2531 | | FLT4:4072L21 antisense siNA (4054 C.) | CACUUCAUGCUCCUCUUGTT | 3596 |
| 2011 | AGCACUGCCACAAGAAGUACCUG | 2528 | | FLT4:2011U21 sense siNA stab04 | B cAcuGccAcAAGAAGuAccTT B 3597 | |
| 3921 | CUGAAGCAGAGAGGACAAGGCA | 2529 | | FLT4:3921U21 sense siNA stab04 | B GAAGcAGAGAGGAGAAGGTT B 3598 | |
| 4038 | AAAGAGGAACCAGGAGGACAAGA | 2530 | | FLT4:4038U21 sense siNA stab04 | B AGAGGAAccAGGAGGAcAATT B 3599 | |
| 4054 | GACAAGAGGAGCAUGAAAGUGGA | 2531 | | FLT4:4054U21 sense siNA stab04 | B cAAGAGGAcAuGAAAGuGTT B 3600 | |
| 2011 | AGCACUGCCACAAGAAGUACCUG | 2528 | | FLT4:2029L21 antisense siNA (2011 C.) stab05 | GGuAcuucuuGuGGcAGuGTsT | 3601 |
| 3921 | CUGAAGCAGAGAGGACAAGGCA | 2529 | | FLT4:3939L21 antisense siNA (3921 C.) stab05 | ccuucuccucucuGcuucTsT | 3602 |
| 4038 | AAAGAGGAACCAGGAGGACAAGA | 2530 | | FLT4:4056L21 antisense siNA | uuGuccuccuGGuuccucuTsT | 3603 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 4054 | GACAAGAGGAGCAUGAAAGUGGA | 2531 | | (4038 C.) stab05 | cAcuuucAugCucucuuGTsT | 3604 |
| 2011 | AGCACUGCCACAAGAAGUACCUG | 2528 | | FLT4:4072L21 antisense siNA stab05 (4054 C.) stab05 | B cACuGccAcAAGAAGuAccTT | 3605 |
| 3921 | CUGAAGCAGAGAGAGGAAGGCA | 2529 | | FLT4:2011U21 sense siNA stab07 | B GAAGcAGAGAGAGGAAGGCTT | 3606 |
| 4038 | AAAGAGGAACCAGGAGGACAAGA | 2530 | | FLT4:3921U21 sense siNA stab07 | B AGAGGAAccAGGAGGAcAATT | 3607 |
| 4054 | GACAAGAGGAGCAUGAAAGUGGA | 2531 | | FLT4:4038U21 sense siNA stab07 | B cAAGAGGAGcAuGAAAGuGTT | 3608 |
| 2011 | AGCACUGCCACAAGAAGUACCUG | 2528 | | FLT4:4054U21 sense siNA stab07 | GGuAcuucuuGuGGcAGuGTsT | 3609 |
| 3921 | CUGAAGCAGAGAGAGGAAGGCA | 2529 | | FLT4:2029L21 antisense siNA (2011 C.) stab11 | ccuucucucucuGcuucTsT | 3610 |
| 4038 | AAAGAGGAACCAGGAGGACAAGA | 2530 | | FLT4:3939L21 antisense siNA (3921 C.) stab11 | uuGuccuccuGGuccucuTsT | 3611 |
| 4054 | GACAAGAGGAGCAUGAAAGUGGA | 2531 | | FLT4:4056L21 antisense siNA (4038 C.) stab11 | cAcuuucAuGcucucuuGTsT | 3612 |
| 1666 | ACUCUAUGUGACCACCAAGAAGUA | 2532 | | FLT4:4072L21 antisense siNA (4054 C.) stab11 | UUCUAUGUGACCACCAUCCTT | 3613 |
| 2009 | CAAGCACUGCCACAAGAAGUACC | 2533 | | FLT4:1666U21 sense siNA stab11 | AGCACUGCCACAAGAAGUATT | 3614 |
| 2815 | AGUACGGCAACCUCUCCAACUUC | 2534 | | FLT4:2009U21 sense siNA stab11 | UACGGCAACCUCUCCAACUTT | 3615 |
| 1666 | ACUCUAUGUGACCACCAAGAAGUA | 2532 | | FLT4:2815U21 sense siNA stab11 | GGAUGGUGGUCACAUAGAATT | 3616 |
| 2009 | CAAGCACUGCCACAAGAAGUACC | 2533 | 31907 | FLT4:1684L21 antisense siNA (1666 C.) | UACUCUUGGUGGCAGUGCUTT | 3617 |
| 2815 | AGUACGGCAACCUCUCCAACUUC | 2534 | 31909 | FLT4:2027L21 antisense siNA (2009 C.) | AGUUGGAGAGGUUGCCGUATT | 3618 |
| 1609 | CUGCCAUGUACAAGUGUGGGUC | 2535 | 34383 | FLT4:2833L21 antisense siNA (2815 C.) | B GCCAUGUACAAGUGUGGGTT | 3619 |
| 1666 | ACUCUAUGUGACCACCAAGAAGUA | 2532 | 34384 | FLT4:1609U21 sense siNA stab09 | B UUCUAUGUGACCACCAUCCTT | 3620 |
| 2009 | CAAGCACUGCCACAAGAAGUACC | 2533 | 34385 | FLT4:1666U21 sense siNA stab09 | B AGCACUGCCACAAGAAGUATT | 3621 |
| 2011 | AGCACUGCCACAAGAAGUACCUG | 2528 | 34386 | FLT4:2009U21 sense siNA stab09 | B CACUGCCACAAGAAGUACCTT | 3622 |
| 2014 | ACUGCCACAAGAAGUACCUGUCG | 2536 | 34387 | FLT4:2011U21 sense siNA stab09 | B UGCCACAAGAAGUACCUGUTT | 3623 |
| 2815 | AGUACGGCAACCUCUCCAACUUC | 2534 | 34388 | FLT4:2014U21 sense siNA stab09 | B UACGGCAACCUCUCCAACUTT | 3624 |
| 3172 | UGGUGAAGAUCUGUGACUUUGGC | 2537 | 34389 | FLT4:2815U21 sense siNA stab09 | B GUGAAGAUCUGUGACUUUGTT | 3625 |
| 3176 | GAAGAUCUGUGACUUUGGCCUUG | 2538 | 34390 | FLT4:3172U21 sense siNA stab09 | B AGAUCUGUGACUUUGGCCUTT | 3626 |
| 1609 | CUGCCAUGUACAAGUGUGGGUC | 2535 | 34391 | FLT4:3176U21 sense siNA stab09 | CCACACACUUGACAUGGCTsT | 3627 |
| 1666 | ACUCUAUGUGACCACCAAGAAGUA | 2532 | 34392 | FLT4:1627L21 antisense siNA (1609 C.) stab10 | GGAUGGUGGUCACAUAGAATsT | 3628 |
| 2009 | CAAGCACUGCCACAAGAAGUACC | 2533 | 34393 | FLT4:1684L21 antisense siNA (1666 C.) stab10 | UACUCUUGGUGGCAGUGCUTsT | 3629 |
| 2011 | AGCACUGCCACAAGAAGUACCUG | 2528 | 34394 | FLT4:2027L21 antisense siNA (2009 C.) stab10 | GGUACUUCUUGUGGCAGUGTsT | 3630 |
| 2014 | ACUGCCACAAGAAGUACCUGUCG | 2536 | 34395 | FLT4:2029L21 antisense siNA (2011 C.) stab10 | ACAGGUACUUCUUGUGGCATsT | 3631 |
| 2815 | AGUACGGCAACCUCUCCAACUUC | 2534 | 34396 | FLT4:2032L21 antisense siNA (2014 C.) stab10 | AGUUGGAGAGGUUGCCGUATsT | 3632 |
| 3172 | UGGUGAAGAUCUGUGACUUUGGC | 2537 | 34397 | FLT4:2833L21 antisense siNA (2815 C.) stab10 | CAAAGUCACAGAUCUUCACTsT | 3633 |
| 3176 | GAAGAUCUGUGACUUUGGCCUUG | 2538 | 34398 | FLT4:3190L21 antisense siNA (3172 C.) stab10 | AGGCCAAAGUCACAGAUCUTsT | 3634 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1609 | CUGCCAUGUACAAGUGUGUGGUC | 2535 | 34399 | FLT4:1627L21 antisense siNA (3176 C.) stab10 | ccAcAcAcuuGuAcAuGGcTsT | 3635 |
| 1666 | ACUCUAUGUGACCACCAUCCCC | 2532 | 34400 | FLT4:1684L21 antisense siNA (1609 C.) stab08 | GGAgGuGGuCAcAuAGAATsT | 3636 |
| 2009 | CAAGCACUGCCACAAGAAGUACC | 2533 | 34401 | FLT4:2027L21 antisense siNA (1666 C.) stab08 | uAcuucuuGuGGcAGuGcuTsT | 3637 |
| 2011 | AGCACUGCCACAAGAAGUACCUG | 2528 | 34402 | FLT4:2029L21 antisense siNA (2009 C.) stab08 | GGuAcuucuuGuGGcAGuGTsT | 3638 |
| 2014 | ACUGCCACAAGAAGUACCUGUCG | 2536 | 34403 | FLT4:2032L21 antisense siNA (2011 C.) stab08 | AcAGGuAcuucuuGuGGcATsT | 3639 |
| 2815 | AGUACGGCAACCUCUCCAACUUC | 2534 | 34404 | FLT4:2833L21 antisense siNA (2014 C.) stab08 | AGuuGGAGAGGuGccGuATsT | 3640 |
| 3172 | UGGUGAAGAUCUGUGACUUUGGC | 2537 | 34405 | FLT4:3190L21 antisense siNA (2815 C.) stab08 | cAAAGucACAGAucuucAcTsT | 3641 |
| 3176 | GAAGAUCUGUGACUUUGCCCUUG | 2538 | 34406 | FLT4:3194L21 antisense siNA (3172 C.) stab08 | AGGccAAAGucAGAucuuTsT | 3642 |

VEGF

| Target Pos | Target | Seq ID | Cmpd # | Aliases | Sequence | Seq ID |
|---|---|---|---|---|---|---|
| 329 | GCAAGAGCUCCAGAGAGAAGUCG | 2539 | 32166 | VEGF:331U21 sense siNA | AAGAGCUCCAGAGAGAAGUTT | 3643 |
| 414 | CAAAGUGAGUGACCUGCUUUUGG | 2540 | 32167 | VEGF:416U21 sense siNA | AAGUGAGUGAccuGCUUUUTT | 3644 |
| 1151 | ACGAAGUGGUGAAGUUCAUGGAU | 2541 | 32168 | VEGF:1153U21 sense siNA | GAAGUGGUGAAGUUCAUGGTT | 3645 |
| 1212 | GGUGGACAUCUUCCAGGAGUACC | 2542 | 32525 | VEGF:1214U21 sense siNA | UGGACAUCUUCCAGGAGUATT | 3646 |
| 1213 | GUGGACAUCUUCCAGGAGUACCC | 2543 | 32526 | VEGF:1215U21 sense siNA | GGACAUCUUCCAGGAGUACTT | 3647 |
| 1215 | GGACAUCUUCCAGGAGUACCUG | 2544 | 32527 | VEGF:1217U21 sense siNA | ACAUCUUCCAGGAGUACCTT | 3648 |
| 1334 | AGUCCAACAUCACCAUGCAGAUU | 2545 | 32169 | VEGF:1336U21 sense siNA | UCCAACAUCACCAUGCAGATT | 3649 |
| 1650 | CGAACGUACUUGCAGAUGUGACA | 2546 | 32540 | VEGF:1652U21 sense siNA | AACGUACUUGCAGAUGUGATT | 3650 |
| 329 | GCAAGAGCUCCAGAGAGAAGUCG | 2539 | 32170 | VEGF:349L21 antisense siNA (331 C.) | ACUCUCUCUGGAGCUCUUTT | 3651 |
| 414 | CAAAGUGAGUGACCUGCUUUUGG | 2540 | 32171 | VEGF:434L21 antisense siNA (416 C.) | AAAAGCAGGUCACUCACUUTT | 3652 |
| 1151 | ACGAAGUGGUGAAGUUCAUGGAU | 2541 | 32172 | VEGF:1171L21 antisense siNA (1153 C.) | CCAUGAACUUCACCACUUCTT | 3653 |
| 1212 | GGUGGACAUCUUCCAGGAGUACC | 2542 | 32543 | VEGF:1232L21 antisense siNA (1214 C.) | UACUCCUGGAAGAUGUCCATT | 3654 |
| 1213 | GUGGACAUCUUCCAGGAGUACCC | 2543 | 32544 | VEGF:1233L21 antisense siNA (1215 C.) | GUACUCCUGGAAGAUGUCTT | 3655 |
| 1215 | GGACAUCUUCCAGGAGUACCCUG | 2544 | 32545 | VEGF:1235L21 antisense siNA (1217 C.) | GGGUACUCCUGGAAGAUGATT | 3656 |
| 1334 | AGUCCAACAUCACCAUGCAGAUU | 2545 | 32173 | VEGF:1354L21 antisense siNA (1336 C.) | UCUGCAUGGUGAUGUUGGATT | 3657 |
| 1650 | CGAACGUACUUGCAGAUGUGACA | 2546 | 32558 | VEGF:1670L21 antisense siNA (1652 C.) | UCACAUCUGCAAGUACGUTT | 3658 |
| 329 | GCAAGAGCUCCAGAGAGAAGUCG | 2539 | | VEGF:331U21 sense siNA stab04 | B AAGAGcuccAGAGAGAAGuTT | 3659 |
| 414 | CAAAGUGAGUGACCUGCUUUUGG | 2540 | | VEGF:416U21 sense siNA stab04 | B AAGuGAGuGAccuGcuuuuTT | 3660 |
| 1151 | ACGAAGUGGUGAAGUUCAUGGAU | 2541 | | VEGF:1153U21 sense siNA stab04 | B GAAGuGGuGAAGuucAuGGTT | 3661 |
| 1212 | GGUGGACAUCUUCCAGGAGUACC | 2542 | | VEGF:1214U21 sense siNA stab04 | B uGGAcAucuuccAGGAGuATT | 3662 |
| 1213 | GUGGACAUCUUCCAGGAGUACCC | 2543 | | VEGF:1215U21 sense siNA stab04 | B GGAcAucuuccAGGAGuAcTT | 3663 |
| 1215 | GGACAUCUUCCAGGAGUACCCUG | 2544 | | VEGF:1217U21 sense siNA stab04 | B AcAucuuccAGGAGuAcccTT | 3664 |
| 1334 | AGUCCAACAUCACCAUGCAGAUU | 2545 | | VEGF:1336U21 sense siNA stab04 | B uccAAcAucAccAuGcAGATT | 3665 |
| 1650 | CGAACGUACUUGCAGAUGUGACA | 2546 | | VEGF:1652U21 sense siNA stab04 | B AAcGuAcuuGcAGAuGuGATT | 3666 |
| 329 | GCAAGAGCUCCAGAGAGAAGUCG | 2539 | | VEGF:349L21 antisense siNA (331 C.) stab05 | AcucucucuGGAGcucuuTsT | 3667 |
| 414 | CAAAGUGAGUGACCUGCUUUUGG | 2540 | | VEGF:434L21 antisense siNA (416 C.) stab05 | AAAAGcAGGucAcucAcuuTsT | 3668 |
| 1151 | ACGAAGUGGUGAAGUUCAUGGAU | 2541 | | VEGF:1171L21 antisense siNA (1153 C.) stab05 | ccAuGAAcuucAccAcuucTsT | 3669 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1212 | GGUGGACAUCUUCCAGGAGUACC | 2542 | | VEGF:1232L21 antisense siNA (1214 C.) stab05 | uAcuccuGGAAGAuGuccATsT | 3670 |
| 1213 | GUGGACAUCUUCCAGGAGUACCC | 2543 | | VEGF:1233L21 antisense siNA (1215 C.) stab05 | GuAcuccuGGAAGAuGuccTsT | 3671 |
| 1215 | GGACAUCUUCCAGGAGUACCCUG | 2544 | | VEGF:1235L21 antisense siNA (1217 C.) stab05 | GGGuAcuccuGGAAGAuGuTsT | 3672 |
| 1334 | AGUCCAACAUCACCAUGCAGAUU | 2545 | | VEGF:1354L21 antisense siNA (1336 C.) stab05 | ucuGcAuGGuGAuGuuGGATsT | 3673 |
| 1650 | CGAACGUACUUGCAGAUGUGACA | 2546 | | VEGF:1670L21 antisense siNA (1652 C.) stab05 | ucAcAucGcAAGuAcGuuTsT | 3674 |
| 329G | CAAGAGCUCCAGAGAGAAGUCG | 2539 | | VEGF:331U21 sense siNA stab07 | B AAGAGCuccAGAGAGAAGuTT | 3675 |
| 414C | AAAGUGAGUGACCUGCUUUUGG | 2540 | | VEGF:416U21 sense siNA stab07 | B AAGuGAGuGAccuGcuuuuTT | 3676 |
| 1151 | ACGAAGUGGUGACAUCCAGGAU | 2541 | | VEGF:1153U21 sense siNA stab07 | B GAAGuGGuGAcAuccAGGTT | 3677 |
| 1212 | GGUGGACAUCUUCCAGGAGUACC | 2542 | 33977 | VEGF:1214U21 sense siNA stab07 | B uGGAcAucuuccAGGAGuATT | 3678 |
| 1213 | GUGGACAUCUUCCAGGAGUACCC | 2543 | 33978 | VEGF:1215U21 sense siNA stab07 | B GGAcAucuuccAGGAGuAcTT | 3679 |
| 1215 | GGACAUCUUCCAGGAGUACCCUG | 2544 | | VEGF:1217U21 sense siNA stab07 | B AcAucuuccAGGAGuAcccTT | 3680 |
| 1334 | AGUCCAACAUCACCAUGCAGAUU | 2545 | | VEGF:1336U21 sense siNA stab07 | B uccAAcAucAccAuGcAGATT | 3681 |
| 1650 | CGAACGUACUUGCAGAUGUGACA | 2546 | | VEGF:1652U21 sense siNA stab07 | B AAcGuAcuuGcAGAuGuGATT | 3682 |
| 329 | GCAAGAGCUCCAGAGAGAAGUCG | 2539 | | VEGF:349L21 antisense siNA (331 C.) stab18 | AcucucuGGAGcucuuTsT | 3683 |
| 414 | CAAAGUGAGUGACCUGCUUUUGG | 2540 | | VEGF:434L21 antisense siNA (416 C.) stab18 | AAAAGcAGGucAcucActuTsT | 3684 |
| 1151 | ACGAAGUGGUGACAUCCAGGAU | 2541 | | VEGF:1171L21 antisense siNA (1153 C.) stab11 | ccAuGAAcuucAccAcuucTsT | 3685 |
| 1212 | GGUGGACAUCUUCCAGGAGUACC | 2542 | | VEGF:1232L21 antisense siNA (1214 C.) stab11 | uAcuccuGGAAGAuGuccATsT | 3686 |
| 1213 | GUGGACAUCUUCCAGGAGUACCC | 2543 | | VEGF:1233L21 antisense siNA (1215 C.) stab11 | GuAcuccuGGAAGAuGuccTsT | 3687 |
| 1215 | GGACAUCUUCCAGGAGUACCCUG | 2544 | | VEGF:1235L21 antisense siNA (1217 C.) stab11 | GGGuAcuccuGGAAGAuGuTsT | 3688 |
| 1334 | AGUCCAACAUCACCAUGCAGAUU | 2545 | | VEGF:1354L21 antisense siNA (1336 C.) stab11 | ucuGcAuGGuGAuGuuGGATsT | 3689 |
| 1650 | CGAACGUACUUGCAGAUGUGACA | 2546 | | VEGF:1670L21 antisense siNA (1652 C.) stab11 | ucAcAucGcAAGuAcGuuTsT | 3690 |
| 329 | GCAAGAGCUCCAGAGAGAAGUCG | 2539 | | VEGF:349L21 antisense siNA (331 C.) stab18 | B AAGAGCuCCAGAGAGAAGuTT | 3691 |
| 414 | CAAAGUGAGUGACCUGCUUUUGG | 2540 | | VEGF:434L21 antisense siNA (416 C.) stab18 | B AAGuGAGuGAccuGcuucAuGGTT | 3692 |
| 1151 | ACGAAGUGGUGACAUCCAGGAU | 2541 | | VEGF:1171L21 antisense siNA (1153 C.) stab18 | B GAAGuGGuGAcAuccAGGTT | 3693 |
| 1212 | GGUGGACAUCUUCCAGGAGUACC | 2542 | | VEGF:1232L21 antisense siNA (1214 C.) stab18 | B uGGACAIcuuccAGGAGuATT | 3694 |
| 1213 | GUGGACAUCUUCCAGGAGUACCC | 2543 | | VEGF:1233L21 antisense siNA (1215 C.) stab18 | B GGACAucuuccAGGAGuAcTT | 3695 |
| 1215 | GGACAUCUUCCAGGAGUACCCUG | 2544 | | VEGF:1235L21 antisense siNA (1217 C.) stab18 | B AcAucuuccAGGAGuAcccTT | 3696 |
| 1334 | AGUCCAACAUCACCAUGCAGAUU | 2545 | | VEGF:1354L21 antisense siNA (1336 C.) stab18 | B uccAAcAucAccAuGcAGATT | 3697 |
| 1650 | CGAACGUACUUGCAGAUGUGACA | 2546 | | VEGF:1670L21 antisense siNA (1652 C.) stab18 | B AAcGuAcuuGcAGAuGuGATT | 3698 |
| 329 | GCAAGAGCUCCAGAGAGAAGUCG | 2539 | | VEGF:349U21 antisense siNA (331 C.) stab08 | ActucucuGGAGcucuuuTsT | 3699 |
| 414 | CAAAGUGAGUGACCUGCUUUUGG | 2540 | | VEGF:434U21 antisense siNA (416 C.) stab08 | AAAAgcAGGucActcActuTsT | 3700 |
| 115 | 1ACGAAGUGGUGACAUCCAGGAGUACC | 2541 | | VEGF:1171L21 sense siNA stab08 | ccAuGAAcuucAccAcuucTsT | 3701 |
| 1212 | GGUGGACAUCUUCCAGGAGUACC | 2542 | 33983 | VEGF:1232L21 sense siNA stab08 | uAcuccuGGAAGAuGuccATsT | 3702 |
| 1213 | GUGGACAUCUUCCAGGAGUACCC | 2543 | 33984 | VEGF:1233L21 sense siNA stab08 | GuAcuccuGGAAGAuGuccTsT | 3703 |
| 1215 | GGACAUCUUCCAGGAGUACCCUG | 2544 | | VEGF:1235L21 sense siNA stab08 | GGGuAcuccuGGAAGAuGuTsT | 3704 |
| 1334 | AGUCCAACAUCACCAUGCAGAUU | 2545 | | VEGF:1354L21 sense siNA stab08 | ucuGcAuGGuGAuGuuGGATsT | 3705 |
| 1650 | CGAACGUACUUGCAGAUGUGACA | 2546 | | VEGF:1670L21 sense siNA stab08 | ucAcAucGcAAGuAcGuuTsT | 3706 |
| 329 | GCAAGAGCUCCAGAGAGAAGUCG | 2539 | | VEGF:331U21 sense siNA stab09 | B AAGAGCuCCAGAGAGAAGuTT | 3707 |
| 414 | CAAAGUGAGUGACCUGCUUUUGG | 2540 | | VEGF:416U21 sense siNA stab09 | B AAGuGAGuGAccuGcuuuuTT | 3708 |
| 1151 | ACGAAGUGGUGACAUCCAGGAU | 2541 | | VEGF:1153U21 sense siNA stab09 | B GAAGuGGuGAcAuccAGGTT | 3709 |
| 1212 | GGUGGACAUCUUCCAGGAGUACC | 2542 | 33965 | VEGF:1214U21 sense siNA stab09 | B uGGACAucuuccAGGAGuATT | 3710 |
| 1213 | GUGGACAUCUUCCAGGAGUACCC | 2543 | 33966 | VEGF:1215U21 sense siNA stab09 | B ACAUCUUCCAGGAGuACCTT | 3711 |
| 1215 | GGACAUCUUCCAGGAGUACCCUG | 2544 | | VEGF:1217U21 sense siNA stab09 | B UCCAAcAucAccAuGcAGATT | 3712 |
| 1334 | AGUCCAACAUCACCAUGCAGAUU | 2545 | | VEGF:1336U21 sense siNA stab09 | B AAcGuAcuuGcAGAuGuGATT | 3713 |
| 1650 | CGAACGUACUUGCAGAUGUGACA | 2546 | | VEGF:1652U21 sense siNA stab09 | B AAcGuAcuuGcAGAuGuGATT | 3714 |
| 329 | GCAAGAGCUCCAGAGAGAAGUCG | 2539 | | VEGF:349L21 antisense siNA (331 C.) stab10 | ACUUCUCUGGAGcucuTsT | 3715 |
| 414 | CAAAGUGAGUGACCUGCUUUUGG | 2540 | | VEGF:434L21 antisense siNA (416 C.) stab10 | AAAAGCAGGUCACUCACUUTsT | 3716 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1151 | ACGAAGUGGUGAAGUUCAUGGAU | 2541 | | VEGF:1171L21 antisense siNA (1153 C.) stab10 | CCAUGAACUUCACCACUUCUsT | 3717 |
| 1212 | GGUGGACAUCUUCCAGGAGUACC | 2542 | 33971 | VEGF:1232L21 antisense siNA (1214 C.) stab10 | UACUCCUGGAAGAUGUCCATsT | 3718 |
| 1213 | GUGGACAUCUUCCAGGAGUACCC | 2543 | 33972 | VEGF:1233L21 antisense siNA (1215 C.) stab10 | GUACUCCUGGAAGAUGUCCTsT | 3719 |
| 1215 | GGACAUCUUCCAGGAGUACCCUG | 2544 | | VEGF:1235L21 antisense siNA (1217 C.) stab10 | UCUGGACAUCCUGGAAGAUGUTsT | 3720 |
| 1334 | AGUCCAACAUCACCAUGCAGAUU | 2545 | | VEGF:1354L21 antisense siNA (1336 C.) stab10 | UCUGCAUGGUGAUGUUGGATsT | 3721 |
| 1650 | CGAACGUACUUGCAGAUGUGACA | 2546 | | VEGF:1670L21 antisense siNA (1652 C.) stab10 | UCACAUCUGCAAGUACGUUTsT | 3722 |
| 329 | GCAAGAGCUCCAGAGAGAAGUCG | 2539 | | VEGF:349L21 antisense siNA (331 C.) stab19 | AcuucucuGgGAGcucuACuuTT | 3723 |
| 414 | ACAAGAGUGAAGUUCAUGGAU | 2540 | | VEGF:434L21 antisense siNA (416 C.) stab19 | AAAAGcAGGuAcAccAcuuTT B | 3724 |
| 1151 | ACGAAGUGGUGAAGUUCAUGGAU | 2541 | | VEGF:1171L21 antisense siNA (1153 C.) stab19 | ccAuGAAcuucAccAcuucTT B | 3725 |
| 1212 | GGUGGACAUCUUCCAGGAGUACC | 2542 | | VEGF:1232L21 antisense siNA (1214 C.) stab19 | uAcuccuGGAAGAuGuccATT B | 3726 |
| 1213 | GUGGACAUCUUCCAGGAGUACCC | 2543 | | VEGF:1233L21 antisense siNA (1215 C.) stab19 | GuAcuccuGGAAGAuGucCTT B | 3727 |
| 1215 | GGACAUCUUCCAGGAGUACCCUG | 2544 | | VEGF:1235L21 antisense siNA (1217 C.) stab19 | GGGuAcucucuGGAAGAuGuTT B | 3728 |
| 1334 | AGUCCAACAUCACCAUGCAGAUU | 2545 | | VEGF:1354L21 antisense siNA (1336 C.) stab19 | ucuGcAuGGuGAuGuuGGATT B | 3729 |
| 1650 | CGAACGUACUUGCAGAUGUGACA | 2546 | | VEGF:1670L21 antisense siNA (1652 C.) stab19 | ucAcAuncGcAAGuAcGuuTT B | 3730 |
| 329 | GCAAGAGCUCCAGAGAGAAGUCG | 2539 | | VEGF:349L21 antisense siNA (331 C.) stab22 | ACUUCUCUCUGGAGCUCUACUUTT B | 3731 |
| 414 | CAAAGAGUGAAGUUCAUGGAU | 2540 | | VEGF:434L21 antisense siNA (416 C.) stab22 | AAAAGCAGGUCACCACUUCUTT B | 3732 |
| 1151 | ACGAAGUGGUGAAGUUCAUGGAU | 2541 | | VEGF:1171L21 antisense siNA (1153 C.) stab22 | CCAUGAACUUCACCACUUCTT B | 3733 |
| 1212 | GGUGGACAUCUUCCAGGAGUACC | 2542 | | VEGF:1232L21 antisense siNA (1214 C.) stab22 | UACUCCUGGAAGAUGUCCATT B | 3734 |
| 1213 | GUGGACAUCUUCCAGGAGUACCC | 2543 | | VEGF:1233L21 antisense siNA (1215 C.) stab22 | GUACUCCUGGAAGAUGUCCTT B | 3735 |
| 1215 | GGACAUCUUCCAGGAGUACCCUG | 2544 | | VEGF:1235L21 antisense siNA (1217 C.) stab22 | GGGUACUCCUGGAAGAUGUTT B | 3736 |
| 1334 | AGUCCAACAUCACCAUGCAGAUU | 2545 | | VEGF:1354L21 antisense siNA (1336 C.) stab22 | UCUGCAUGGUGAUGUUGGATT B | 3737 |
| 1650 | CGAACGUACUUGCAGAUGUGACA | 2546 | | VEGF:1670L21 antisense siNA (1652 C.) stab22 | UCACAUCUGCAAGUACGUUTT B | 3738 |
| 1207 | AGACCCUGUGUGACAUUCCAG | 2547 | | VEGF:1207U21 sense siNA stab00 | ACCCUGGUGACAUUCUCCTT | 3739 |
| 1358 | UAUGCGGAUCAAACCUCACCAAG | 2548 | | VEGF:1358U21 sense siNA stab00 | UGCCGAUCAAACCUCACCATT | 3740 |
| 1419 | AAAUGUGAAUGCAGACCAAAGAA | 2549 | | VEGF:1419U21 sense siNA stab00 | AUGUGAAUGCAGACCAAAGTT | 3741 |
| 1420 | AAUGUGAAUGCAGACCAAAGAAA | 2550 | | VEGF:1420U21 sense siNA stab00 | UGUGAAUGCAGACCAAAGATT | 3742 |
| 1421 | AUGUGAAUGCAGACCAAAGAAAG | 2551 | | VEGF:1421U21 sense siNA stab00 | GUGAAUGCAGACCAAAGAATT | 3743 |
| 1423 | GUGAAUGCAGACCAAAGAAAGAU | 2552 | | VEGF:1423U21 sense siNA stab00 | GAAUGCAGACCAAAGAAAGTT | 3744 |
| 1587 | CAGACGUAAAAUGUUCCUGCAA | 2553 | | VEGF:1587U21 sense siNA stab00 | GACGUAAAAUGUUCCUGCTT | 3745 |
| 1591 | CGUAAAAUGUUCCUGCAAAAAC | 2554 | | VEGF:1591U21 sense siNA stab00 | UGUAAAAUGUUCCUGCAAATT | 3746 |
| 1592 | GUAAAAUGUUCCUGCAAAAACA | 2555 | | VEGF:1592U21 sense siNA stab00 | GUAAAAUGUUCCUGCAAAATT | 3747 |
| 1593 | UAAAAUGUUCCUGCAAAAACAC | 2556 | | VEGF:1593U21 sense siNA stab00 | UAAAAUGUUCCUGCAAAACTT | 3748 |
| 1594 | AAAAAUGUUCCUGCAAAAACACA | 2557 | | VEGF:1594U21 sense siNA stab00 | AAAAUGUUCCUGCAAAAACATT | 3749 |
| 1604 | CCAAAAAACACAGACUCGCGUU | 2558 | | VEGF:1604U21 sense siNA stab00 | GCAAAAACACAGACUCGCGTT | 3750 |
| 1637 | GCACCUGCAGAUGUAACGAACGUA | 2559 | | VEGF:1637U21 sense siNA stab00 | AGCUUGCAGAUGUAACAAGTT | 3751 |
| 1656 | CGUACUUGCAGAUGUGACAAGCC | 2560 | | VEGF:1656U21 sense siNA stab00 | UACUUGCAGAUGUGACAAGTT | 3752 |
| 1207 | AGACCCUGUGUGACAUUCCAG | 2547 | | VEGF:1225L21 antisense siNA (1207 C.) stab00 | UGGAAGAUGUCCACCAGGUTT | 3753 |
| 1358 | UAUGCGGAUCAAACCUCACCAAG | 2548 | | VEGF:1376L21 antisense siNA (1358 C.) stab00 | UGGAGUUUGAUCCGCATT | 3754 |
| 1419 | AAAUGUGAAUGCAGACCAAAGAA | 2549 | | VEGF:1437L21 antisense siNA (1419 C.) stab00 | CUUUGGUCUGCAUUCACAUTT | 3755 |
| 1420 | AAUGUGAAUGCAGACCAAAGAAA | 2550 | | VEGF:1438L21 antisense siNA (1420 C.) stab00 | UCUUUGGUCUGCAUUCACATT | 3756 |
| 1421 | AUGUGAAUGCAGACCAAAGAAAG | 2551 | | VEGF:1439L21 antisense siNA (1421 C.) stab00 | UCUUUGGUCUGCAUUCACUTT | 3757 |
| 1423 | GUGAAUGCAGACCAAAGAAAGAU | 2552 | | VEGF:1441L21 antisense siNA (1423 C.) stab00 | CUUUCUUUGGUCUGCAUUCTT | 3758 |
| 1587 | CAGACGUAAAAUGUUCCUGCAA | 2553 | | VEGF:1605L21 antisense siNA (1587 C.) stab00 | GCAGGAACAUUUUACGUCUTT | 3759 |
| 1591 | CGUAAAAUGUUCCUGCAAAAAC | 2554 | | VEGF:1609L21 antisense siNA (1591 C.) stab00 | UUUUGCAGGAACAUUUUACATT | 3760 |
| 1592 | GUAAAAUGUUCCUGCAAAAACA | 2555 | | VEGF:1610L21 antisense siNA (1592 C.) stab00 | GUUUUGCAGGAACAUUUACTT | 3761 |
| 1593 | UAAAAUGUUCCUGCAAAAACAC | 2556 | | VEGF:1611L21 antisense siNA (1593 C.) stab00 | UGUUUUGCAGGAACAUUUATT | 3762 |
| 1594 | AAAAAUGUUCCUGCAAAAACACA | 2557 | | VEGF:1612L21 antisense siNA (1594 C.) stab00 | UGUUUUUGCAGGAACAUUUTT | 3763 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1604 | CUGCAAAAACACAGACUCGCGUU | 2558 | 32556 | VEGF:1622L21 antisense siNA (1604 C.) stab00 | CGCGAGUCUGUGUUUUGCUU | 3764 |
| 1637 | GCAGCUUGAGUUAAACGAACGUA | 2559 | 32557 | VEGF:1655L21 antisense siNA (1637 C.) stab00 | CGUUCGUUUAAACUCAAGCUU | 3765 |
| 1656 | CGUACUGCAGAUGUGACAAGCC | 2560 | 32559 | VEGF:1674L21 antisense siNA (1656 C.) stab00 | CUUGUCACAUCUGCAAGUAUU | 3766 |
| 1206 | GAGACCCUGGUGGACAUCUUCCA | 2561 | 32560 | VEGF:1206U21 sense siNA stab00 | GACCCUGGUGGACAUCUUCUU | 3767 |
| 1208 | GACCCUGGUGGACAUCUUCCAGG | 2562 | 32561 | VEGF:1208U21 sense siNA stab00 | CCCUGGUGGACAUCUUCCAUU | 3768 |
| 1551 | UCAGAGCGGAGAAAGCAUUGUU | 2563 | 32562 | VEGF:1551U21 sense siNA stab00 | AGAGCGGAGAAAGCAUUUGUU | 3769 |
| 1582 | AUCCGCAGACGUGUAAAUGUUCC | 2564 | 32563 | VEGF:1582U21 sense siNA stab00 | CCGCAGACGUGUAAAUGUUUU | 3770 |
| 1584 | CCGCAGACGUGUAAAUGUUCCUG | 2565 | 32564 | VEGF:1584U21 sense siNA stab00 | GCAGACGUGUAAAUGUUCCUU | 3771 |
| 1585 | CGCAGACGUGUAAAUGUUCCUGC | 2566 | 32565 | VEGF:1585U21 sense siNA stab00 | CAGACGUGUAAAUGUUCCUUU | 3772 |
| 1589 | GACGUGUAAAUGUUCCUGCAAAA | 2567 | 32566 | VEGF:1589U21 sense siNA stab00 | CGUGUAAAUGUUCCUGCAAUU | 3773 |
| 1595 | UAAAUGUUCCUGCAAAAACACAG | 2568 | 32567 | VEGF:1595U21 sense siNA stab00 | AAUGUUCCUGCAAAAACACUU | 3774 |
| 1596 | AAAUGUUCCUGCAAAAACACAGA | 2569 | 32568 | VEGF:1596U21 sense siNA stab00 | AUGUUCCUGCAAAAACACAUU | 3775 |
| 1602 | UCCUGCAAAAACACAGACUCGCG | 2570 | 32569 | VEGF:1602U21 sense siNA stab00 | CUGCAAAAACACAGACUCGUU | 3776 |
| 1603 | CCUGCAAAAACACAGACUCGCGU | 2571 | 32570 | VEGF:1603U21 sense siNA stab00 | UGCAAAAACACAGACUCGCUU | 3777 |
| 1630 | AGGCGAGGCAGCUUGAGUUAAAC | 2572 | 32571 | VEGF:1630U21 sense siNA stab00 | GCGAGGCAGCUUGAGUUAAUU | 3778 |
| 1633 | CGAGGCAGCUUGAGUUAAACGAA | 2573 | 32572 | VEGF:1633U21 sense siNA stab00 | AGGCAGCUUGAGUUAAACGUU | 3779 |
| 1634 | GAGGCAGCUUGAGUUAAACGAAC | 2574 | 32573 | VEGF:1634U21 sense siNA stab00 | GGCAGCUUGAGUUAAACGAUU | 3780 |
| 1635 | AGGCAGCUUGAGUUAAACGAACG | 2575 | 32574 | VEGF:1635U21 sense siNA stab00 | GCAGCUUGAGUUAAACGAAUU | 3781 |
| 1636 | GGCAGCUUGAGUUAAACGAACGU | 2576 | 32575 | VEGF:1636U21 sense siNA stab00 | CAGCUUGAGUUAAACGAACUU | 3782 |
| 1648 | UAAACGAACGUACUGCAGAUGUG | 2577 | 32576 | VEGF:1648U21 sense siNA stab00 | AACGAACGUACUGCAGAUGUU | 3783 |
| 1649 | AAACGAACGUACUGCAGAUGUGA | 2578 | 32577 | VEGF:1649U21 sense siNA stab00 | ACGAACGUACUGCAGAUGUUU | 3784 |
| 1206 | GAGACCCUGGUGGACAUCUUCCA | 2561 | 32578 | VEGF:1224L21 antisense siNA (1206 C.) stab00 | GAAGAUGUCCACCAGGGUU | 3785 |
| 1208 | GACCCUGGUGGACAUCUUCCAGG | 2562 | 32579 | VEGF:1226L21 antisense siNA (1208 C.) stab00 | UGGAAGAUGUCCACCAGGGUU | 3786 |
| 1551 | UCAGAGCGGAGAAAGCAUUGUU | 2563 | 32580 | VEGF:1569L21 antisense siNA (1551 C.) stab00 | CAAAUGCUUUCUCCGCUCUUU | 3787 |
| 1582 | AUCCGCAGACGUGUAAAUGUUCC | 2564 | 32581 | VEGF:1600L21 antisense siNA (1582 C.) stab00 | AACAUUUACACGUCUGCGGUU | 3788 |
| 1584 | CCGCAGACGUGUAAAUGUUCCUG | 2565 | 32582 | VEGF:1602L21 antisense siNA (1584 C.) stab00 | GGAACAUUUACACGUCUGCUU | 3789 |
| 1585 | CGCAGACGUGUAAAUGUUCCUGC | 2566 | 32583 | VEGF:1603L21 antisense siNA (1585 C.) stab00 | AGGAACAUUUACACGUCUGUU | 3790 |
| 1589 | GACGUGUAAAUGUUCCUGCAAAA | 2567 | 32584 | VEGF:1607L21 antisense siNA (1589 C.) stab00 | UUGCAGGAACAUUUACACGUU | 3791 |
| 1595 | UAAAUGUUCCUGCAAAAACACAG | 2568 | 32585 | VEGF:1613L21 antisense siNA (1595 C.) stab00 | GUGUUUUGCAGGAACAUUUU | 3792 |
| 1596 | AAAUGUUCCUGCAAAAACACAGA | 2569 | 32586 | VEGF:1614L21 antisense siNA (1596 C.) stab00 | UGUGUUUUGCAGGAACAUUUU | 3793 |
| 1602 | UCCUGCAAAAACACAGACUCGCG | 2570 | 32587 | VEGF:1620L21 antisense siNA (1602 C.) stab00 | CGAGUCUGUGUUUUUGCAGUU | 3794 |
| 1603 | CCUGCAAAAACACAGACUCGCGU | 2571 | 32588 | VEGF:1621L21 antisense siNA (1603 C.) stab00 | GCGAGUCUGUGUUUUUGCAUU | 3795 |
| 1630 | AGGCGAGGCAGCUUGAGUUAAAC | 2572 | 32589 | VEGF:1648L21 antisense siNA (1630 C.) stab00 | UUAACUCAAGCUGCCUCGCUU | 3796 |
| 1633 | CGAGGCAGCUUGAGUUAAACGAA | 2573 | 32590 | VEGF:1651L21 antisense siNA (1633 C.) stab00 | CGUUUAACUCAAGCUGCCUUU | 3797 |
| 1634 | GAGGCAGCUUGAGUUAAACGAAC | 2574 | 32591 | VEGF:1652L21 antisense siNA (1634 C.) stab00 | UCGUUUAACUCAAGCUGCCUU | 3798 |
| 1635 | AGGCAGCUUGAGUUAAACGAACG | 2575 | 32592 | VEGF:1653L21 antisense siNA (1635 C.) stab00 | UUCGUUUAACUCAAGCUGCUU | 3799 |
| 1636 | GGCAGCUUGAGUUAAACGAACGU | 2576 | 32593 | VEGF:1654L21 antisense siNA (1636 C.) stab00 | GUUCGUUUAACUCAAGCUGUU | 3800 |
| 1648 | UAAACGAACGUACUGCAGAUGUG | 2577 | 32594 | VEGF:1666L21 antisense siNA (1648 C.) stab00 | AUCUGCAAGUACGUUCGUUUU | 3801 |
| 1649 | AAACGAACGUACUGCAGAUGUGA | 2578 | 32595 | VEGF:1667L21 antisense siNA (1649 C.) stab00 | CAUCUGCAAGUACGUUCGUUU | 3802 |
| 1358 | UAUGCCGAUCAACCUCACCAAG | 2548 | 32968 | VEGF:1358U21 sense siNA stab07 | B uGcGGAucAAAcuccAccATT | 3803 |
| 1419 | AAAUGUGAAUGCAGACCAAAGAA | 2549 | 32969 | VEGF:1419U21 sense siNA stab07 | B AuGuGAAuGcAGAccAAAGTT | 3804 |
| 1421 | AUGUGAAUGCAGACCAAAGAAAG | 2551 | 32970 | VEGF:1421U21 sense siNA stab07 | B GuGAAuGcAGAccAAAGAATT | 3805 |
| 1596 | AAAUGUUCCUGCAAAAACACAGA | 2569 | 32971 | VEGF:1596U21 sense siNA stab07 | B AuGuuccuGcAAAAAcAcATT | 3806 |
| 1636 | GGCAGCUUGAGUUAAACGAACGU | 2576 | 32972 | VEGF:1636U21 sense siNA stab07 | B cAGcuuGAGuuAAAcGAAcTT | 3807 |
| 1358 | UAUGCCGAUCAACCUCACCAAG | 2548 | 32973 | VEGF:1376L21 antisense siNA (1358 C.) stab08 | uGGuGAGGuuGAuccGcATsT | 3808 |
| 1419 | AAAUGUGAAUGCAGACCAAAGAA | 2549 | 32974 | VEGF:1437L21 antisense siNA (1419 C.) stab08 | cuuuGGucucGcAuucAcATsT | 3809 |
| 1421 | AUGUGAAUGCAGACCAAAGAAAG | 2551 | 32975 | VEGF:1439L21 antisense siNA (1421 C.) stab08 | uucuuuGGucucGcAuucAcTsT | 3810 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1596 | AAAUGUUCCUGCAAAAACACAGA | 2569 | 32976 | VEGF:1614L21 antisense siNA (1596 C.) stab08 | uGuGuuuuuGcAGGAAcAUTsT | 3811 |
| 1636 | GGCAGCUUGAGUUAAACGAACGU | 2576 | 32977 | VEGF:1654L21 antisense siNA (1636 C.) stab08 | GuucGuuuAcucAAGcuGTsT | 3812 |
| 1358 | UAUGCGGAUCAAACCUCACCAAG | 2548 | 32978 | VEGF:1358U21 sense siNA stab09 | B UGCGGAUCAAACCUCACCAUU | 3813 |
| 1419 | AUGUGAAUGCAGACCAAAGAAAG | 2549 | 32979 | VEGF:1419U21 sense siNA stab09 | B AUGUGAAUGcAGAccAAAGTT | 3814 |
| 1421 | AUGUGAAUGCAGACCAAAGAAAG | 2551 | 32980 | VEGF:1421U21 sense siNA stab09 | B GUGAAUGcAGAccAAAGAATT | 3815 |
| 1596 | AAAUGUUCCUGCAAAAACACAGA | 2569 | 32981 | VEGF:1596U21 sense siNA stab09 | B AUGUUCCUGcAAAAAcACATT | 3816 |
| 1636 | GGCAGCUUGAGUUAAACGAACGU | 2576 | 32982 | VEGF:1636U21 sense siNA stab09 | B CAGCUUGAGUUAAACGAACTT | 3817 |
| 1358 | UAUGCGGAUCAAACCUCACCAAG | 2548 | 32983 | VEGF:1376L21 antisense siNA (1358 C.) stab10 | UGGUGAGGUUUGAUCCGCATsT | 3818 |
| 1419 | AUGUGAAUGCAGACCAAAGAAAG | 2549 | 32984 | VEGF:1437L21 antisense siNA (1419 C.) stab10 | CUUUGGUCUGCAUUCACAUTsT | 3819 |
| 1421 | AUGUGAAUGCAGACCAAAGAAAG | 2551 | 32985 | VEGF:1439L21 antisense siNA (1421 C.) stab10 | UUCUUUGGUCUGCAUUCACTsT | 3820 |
| 1596 | AAAUGUUCCUGCAAAAACACAGA | 2569 | 32986 | VEGF:1614L21 antisense siNA (1596 C.) stab10 | UGUGUUUUUGCAGGAACAUTsT | 3821 |
| 1636 | GGCAGCUUGAGUUAAACGAACGU | 2576 | 32987 | VEGF:1654L21 antisense siNA (1636 C.) stab10 | GUUCGUUUAACUCAAGCUGTsT | 3822 |
| 1358 | UAUGCGGAUCAAACCUCACCAAG | 2548 | 32998 | VEGF:1358U21 sense siNA inv stab07 | B AccAuccAAAcuAGGcGuTT | 3823 |
| 1419 | AUGUGAAUGCAGACCAAAGAAAG | 2549 | 32999 | VEGF:1419U21 sense siNA inv stab07 | B GAAAccAGAcGuAAGuGuATT | 3824 |
| 1421 | AUGUGAAUGCAGACCAAAGAAAG | 2551 | 33000 | VEGF:1421U21 sense siNA inv stab07 | B AAGAAAccAGAcGuAAGuGTT | 3825 |
| 1596 | AAAUGUUCCUGCAAAAACACAGA | 2569 | 33001 | VEGF:1596U21 sense siNA inv stab07 | B AcACAAAAcGuccuuGuATT | 3826 |
| 1636 | GGCAGCUUGAGUUAAACGAACGU | 2576 | 33002 | VEGF:1636U21 sense siNA inv stab07 | B cAAGcAAuccAAuuuGcuGTT | 3827 |
| 1358 | UAUGCGGAUCAAACCUCACCAAG | 2548 | 33003 | VEGF:1376L21 antisense siNA (1358 C.) inv stab08 | AcGccuAGuuuGGAGuGGuTsT | 3828 |
| 1419 | AUGUGAAUGCAGACCAAAGAAAG | 2549 | 33004 | VEGF:1437L21 antisense siNA (1419 C.) inv stab08 | uAcAcuuAcGucuGuuucuuTsT | 3829 |
| 1421 | AUGUGAAUGCAGACCAAAGAAAG | 2551 | 33005 | VEGF:1439L21 antisense siNA (1421 C.) inv stab08 | cAcuuAcGucuGGuuuucuuTsT | 3830 |
| 1596 | AAAUGUUCCUGCAAAAACACAGA | 2569 | 33006 | VEGF:1614L21 antisense siNA (1596 C.) inv stab08 | uAcAAGGAcGuuuuGuATsT | 3831 |
| 1636 | GGCAGCUUGAGUUAAACGAACGU | 2576 | 33007 | VEGF:1654L21 antisense siNA (1636 C.) inv stab08 | GucGAAccAAuuGcuuGTsT | 3832 |
| 1358 | UAUGCGGAUCAAACCUCACCAAG | 2548 | 33008 | VEGF:1358U21 sense siNA inv stab09 | B ACCAUCCAAACUAGGCGUTT | 3833 |
| 1419 | AUGUGAAUGCAGACCAAAGAAAG | 2549 | 33009 | VEGF:1419U21 sense siNA inv stab09 | B GAAACCAGACGUAAGUGUATT | 3834 |
| 1421 | AUGUGAAUGCAGACCAAAGAAAG | 2551 | 33010 | VEGF:1421U21 sense siNA inv stab09 | B AAGAAACCAGACGUAAGUGTT | 3835 |
| 1596 | AAAUGUUCCUGCAAAAACACAGA | 2569 | 33011 | VEGF:1596U21 sense siNA inv stab09 | B ACACAAAAGCGUCCUUGUATT | 3836 |
| 1636 | GGCAGCUUGAGUUAAACGAACGU | 2576 | 33012 | VEGF:1636U21 sense siNA inv stab09 | B CAAGCAAUUGGAGUUCGACTT | 3837 |
| 1358 | UAUGCGGAUCAAACCUCACCAAG | 2548 | 33013 | VEGF:1376L21 antisense siNA (1358 C.) inv stab09 | ACGCCUAGUUUGGAGUGGUTsT | 3838 |
| 1419 | AUGUGAAUGCAGACCAAAGAAAG | 2549 | 33014 | VEGF:1437L21 antisense siNA (1419 C.) inv stab09 | UACACUUACGUCUGGUUUCTsT | 3839 |
| 1421 | AUGUGAAUGCAGACCAAAGAAAG | 2551 | 33015 | VEGF:1439L21 antisense siNA (1421 C.) inv stab09 | CACUUACGUCUGGUUUUCUTsT | 3840 |
| 1596 | AAAUGUUCCUGCAAAAACACAGA | 2569 | 33016 | VEGF:1614L21 antisense siNA (1596 C.) inv stab09 | UACAAGGACGUCCUUGUATsT | 3841 |
| 1636 | GGCAGCUUGAGUUAAACGAACGU | 2576 | 33017 | VEGF:1654L21 antisense siNA (1636 C.) inv stab09 | GUCGAACUCAAUUGCUUGTsT | 3842 |
| 1420 | AAUGUGAAUGCAGACCAAAGAAA | 2550 | 33968 | VEGF:1420U21 sense siNA stab09 | B UGUGAAUGcAGAccAAAGATT | 3843 |
| 1423 | GUGAAUGCAGACCAAAGAAAGAU | 2552 | 33970 | VEGF:1423U21 sense siNA stab09 | B GAAUGcAGAccAAAGAAAGTT | 3844 |
| 1420 | AAUGUGAAUGCAGACCAAAGAAA | 2550 | 33974 | VEGF:1438L21 antisense siNA (1420 C.) stab10 | UCUUUGGUCUGCAUUCACATsT | 3845 |
| 1423 | GUGAAUGCAGACCAAAGAAAGAU | 2552 | 33976 | VEGF:1441L21 antisense siNA (1423 C.) stab10 | CUUUCUUUGGUCUGCAUUCTsT | 3846 |
| 1420 | AAUGUGAAUGCAGACCAAAGAAA | 2550 | 33980 | VEGF:1420U21 sense siNA stab07 | B uGAAUGcAGAccAAAGAUTT | 3847 |
| 1423 | GUGAAUGCAGACCAAAGAAAGAU | 2552 | 33982 | VEGF:1423U21 sense siNA stab07 | B GAAuGcAGAccAAAGAAAGTT | 3848 |
| 1420 | AAUGUGAAUGCAGACCAAAGAAA | 2550 | 33986 | VEGF:1438L21 antisense siNA (142C C.) stab08 | ucuuuGGucuGcAuucAcATsT | 3849 |
| 1423 | GUGAAUGCAGACCAAAGAAAGAU | 2552 | 33988 | VEGF:1441L21 antisense siNA (1423 C.) stab08 | cuuucuuuGGucuGcAuucTsT | 3850 |
| 1214 | GGUGGACAUCUUCCAGGAGUACC | 2542 | 33989 | VEGF:1214U21 sense siNA inv stab09 | B AUGAGGACCUUCUACAGGUTT | 3851 |
| 1215 | GUGGACAUCUUCCAGGAGUACCC | 2543 | 33990 | VEGF:1215U21 sense siNA inv stab09 | B CAUGAGGACCUUCUACAGGTT | 3852 |
| 1420 | AAUGUGAAUGCAGACCAAAGAAA | 2550 | 33992 | VEGF:1420U21 sense siNA inv stab09 | B AGAAACCAGACGUAAGUGUTT | 3853 |
| 1423 | GUGAAUGCAGACCAAAGAAAGAU | 2552 | 33994 | VEGF:1423U21 sense siNA inv stab09 | B GAAAGAAACCAGACGUAAGUTT | 3854 |
| 1214 | GGUGGACAUCUUCCAGGAGUACC | 2542 | 33995 | VEGF:1232L21 antisense siNA (1214 C.) inv stab09 | ACCUGuAGAAGGUCCUCAUTsT | 3855 |
| 1215 | GUGGACAUCUUCCAGGAGUACCC | 2543 | 33996 | VEGF:1233L21 antisense siNA (1215 C.) inv stab09 | CCGUAGAAGGUCCUCAGGTsT | 3856 |
| 1420 | AAUGUGAAUGCAGACCAAAGAAA | 2550 | 33998 | VEGF:1438L21 antisense siNA (142C C.) inv stab10 | ACACUUACGUCUGGUUUCUTsT | 3857 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1423 | GUGAAUGCAGACCAAAGAAGAU | 2552 | 34000 | VEGF:1441L21 antisense siNA (1423 C.) inv stab10 | CUUACGUCUGGUUUCUUUCTsT | 3858 |
| 1214 | GGUGGACAUCUUCCAGGAGUACC | 2542 | 34001 | VEGF:1214U21 sense siNA inv stab07 | B AUGAGGACCUUCUACAGGUTT | 3859 |
| 1215 | GUGGACAUCUUCCAGGAGUACCC | 2543 | 34002 | VEGF:1215U21 sense siNA inv stab07 | B CAUGAGGACCUUCUACAGGTT | 3860 |
| 1420 | AAUGUGAAUGCAGACCAAAGAAA | 2550 | 34004 | VEGF:1420U21 sense siNA inv stab07 | B AGAAACCAGACGUAAGUGUTT | 3861 |
| 1423 | GUGAAUGCAGACCAAAGAAGAAU | 2552 | 34006 | VEGF:1423U21 sense siNA inv stab07 | B GAAAGAAACCAGACGUAAGTT | 3862 |
| 1214 | GGUGGACAUCUUCCAGGAGUACC | 2542 | 34007 | VEGF:1214L21 antisense siNA (1214 C.) inv stab08 | AccuGuAGAAGGucucuCAuTsT | 3863 |
| 1215 | GUGGACAUCUUCCAGGAGUACCC | 2543 | 34008 | VEGF:1232L21 antisense siNA (1215 C.) inv stab08 | CcuGuAGAAGGucucuCAuGTsT | 3864 |
| 1420 | AAUGUGAAUGCAGACCAAAGAAA | 2550 | 34010 | VEGF:1438L21 antisense siNA (1420 C.) inv stab08 | AcAcuuAcGucuGGuuucuUsT | 3865 |
| 1423 | GUGAAUGCAGACCAAAGAAGAAU | 2552 | 34012 | VEGF:1441L21 antisense siNA (1423 C.) inv stab08 | CuuAcGucuGGuuucuuucTsT | 3866 |
| 1366 | AAACCUCACCAAGGCCAGCACAU | 2579 | 34062 | VEGF:1366U21 sense siNA stab00 (HVEGF5) | ACCUCACCAAGGCCAGCACUT | 3867 |
| 1366 | AAACCUCACCAAGGCCAGCACAU | 2579 | 34064 | VEGF:1384L21 antisense siNA (1366 C.) stab00 (HVEGF5) | GUGCUGGCCUUGGUGAGGUTT | 3868 |
| 1366 | AAACCUCACCAAGGCCAGCACAU | 2579 | 34066 | VEGF:1366U21 sense siNA stab07 (HVEGF5) | B AccucAccAAGGccAGcAcTT | 3869 |
| 1366 | AAACCUCACCAAGGCCAGCACAU | 2579 | 34068 | VEGF:1384L21 antisense siNA (1366 C.) stab08 (HVEGF5) | GuGcuGGccuuGGuGAGGuTsT | 3870 |
| 1366 | AAACCUCACCAAGGCCAGCACAU | 2579 | 34070 | VEGF:1366U21 sense siNA stab09 (HVEGF5) | B ACCUCACCAAGGCCAGCACTT | 3871 |
| 1366 | AAACCUCACCAAGGCCAGCACAU | 2579 | 34072 | VEGF:1384L21 antisense siNA (1366 C.) stab10 (HVEGF5) | GUGCUGGCCUUGGUGAGGUTT | 3872 |
| 1366 | AAACCUCACCAAGGCCAGCACAU | 2579 | 34074 | VEGF:1366U21 sense siNA inv stab00 (HVEGF5) | CACGACCGGAACCACUCCATT | 3873 |
| 1366 | AAACCUCACCAAGGCCAGCACAU | 2579 | 34076 | VEGF:1384L21 antisense siNA (1366 C.) inv stab00 (HVEGF5) | UGGAGUGGUUCCGGUCGUGTT | 3874 |
| 1366 | AAACCUCACCAAGGCCAGCACAU | 2579 | 34078 | VEGF:1366U21 sense siNA inv stab07 (HVEGF5) | B cACGAccGGAAccAcuccATT | 3875 |
| 1366 | AAACCUCACCAAGGCCAGCACAU | 2579 | 34080 | VEGF:1384L21 antisense siNA (1366 C.) inv stab08 (HVEGF5) | uGGAGuGGuuccGGucGuGTsT | 3876 |
| 1366 | AAACCUCACCAAGGCCAGCACAU | 2579 | 34082 | VEGF:1366U21 sense siNA inv stab09 (HVEGF5) | B CACGACCGGAACCACUCCATT | 3877 |
| 1366 | AAACCUCACCAAGGCCAGCACAU | 2579 | 34084 | VEGF:1384L21 antisense siNA (1366 C.) inv stab10 (HVEGF5) | UGGAGUGGUUCCGGUCGUGTsT | 3878 |
| 360 | AGAGAGACGGGUCAGAGAGAGC | 2580 | 34681 | VEGF:360U21 sense siNA stab00 | AGAGACGGGGUCAGAGAGATT | 3879 |
| 1562 | AGCAUUGUUUGUGUACAAGAUC | 2581 | 34682 | VEGF:1562U21 sense siNA stab00 | AGCAUUGUUUGUACAAGATT | 3880 |
| 360 | AGAGAGACGGGUCAGAGAGAGC | 2580 | 34689 | VEGF:378L21 (360 C.) siRNA stab00 | UCUCUCUGACCCCGUCUCUTT | 3881 |
| 1562 | AAAGCAUUGUUUGUGUACAAGA | 2581 | 34690 | VEGF:1580U21 (1562 C.) siRNA stab00 | UCUUGUACAAACAAAUGCUTT | 3882 |
| 162 | UCCCUCUCUUUUUUUUCUUAAACA | 2582 | 36002 | VEGF:162U21 sense siNA stab00 | CCCUCUCUUUUUUUCUAAATT | 3883 |
| 163 | CCCUCUCUUUUUUUUCUUAAACAU | 2583 | 36003 | VEGF:163U21 sense siNA stab00 | CCUCUCUUUUUUUCUAAACTT | 3884 |
| 164 | CCUCUCUUUUUUUUCUUAAACAUU | 2584 | 36004 | VEGF:164U21 sense siNA stab00 | CUCUCUUUUUUUCUAAAACTT | 3885 |
| 166 | UCUCUUUUUUUCUUAAACAUUUU | 2585 | 36005 | VEGF:166U21 sense siNA stab00 | UUCUUUUUUCUAAACAUUTT | 3886 |
| 169 | UCUUUUUUUCUUAAACAUUUUUU | 2586 | 36006 | VEGF:169U21 sense siNA stab00 | UUUUUUCUAAACAUUUUTT | 3887 |
| 171 | UUUUUUUCUUAAACAUUUUUUUA | 2587 | 36007 | VEGF:171U21 sense siNA stab00 | UUUUCUAAACAUUUUUUTT | 3888 |
| 172 | UUUUUUCUUAAACAUUUUUUUAA | 2588 | 36008 | VEGF:172U21 sense siNA stab00 | UUCUAAACAUUUUUUUATT | 3889 |
| 181 | AACAUUUUUUUAAACUGAUGUUU | 2589 | 36009 | VEGF:181U21 sense siNA stab00 | CAUUUUUUUAAACUGUTT | 3890 |
| 187 | UUUUUAAAACUGAUGUUGUUC | 2590 | 36010 | VEGF:187U21 sense siNA stab00 | UUUUAAAACUGAUGUUTT | 3891 |
| 188 | UUUUAAAACUGAUGUUGUUCU | 2591 | 36011 | VEGF:188U21 sense siNA stab00 | UUUAAAACUGAUGUUUCTT | 3892 |
| 192 | UUAAAACUGAUGUUGUUCGUU | 2592 | 36012 | VEGF:192U21 sense siNA stab00 | AAAACUGAUGUUUCCGTT | 3893 |
| 202 | AUGUUCUCGUUUUAAUUAUU | 2593 | 36013 | VEGF:202U21 sense siNA stab00 | UGUUCUCGUUUAAUUATT | 3894 |
| 220 | UUAUUUGCUGAUGCCAUUCCCCA | 2594 | 36014 | VEGF:220U21 sense siNA stab00 | AUUUUGCCUUGCCAUCCCTT | 3895 |
| 237 | UCCCCACUGAAUCGGGCCGACG | 2595 | 36015 | VEGF:237U21 sense siNA stab00 | CCCACUGAAUCGGGCCGATT | 3896 |
| 238 | CCCCACUGAAUCGGGCCGACGG | 2596 | 36016 | VEGF:233U21 sense siNA stab00 | CCACUUGAAUCGGCCGACTT | 3897 |
| 338 | CUCCAGAGAAGUCGAGGAAGA | 2597 | 36017 | VEGF:338U21 sense siNA stab00 | CCAGAGAGAAGUCGAGGATT | 3898 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 339 | UCCAGAGAAGUCGAGGAAGAG | 2598 | 36018 | VEGF:339U21 sense siNA stab00 | CAGAGAGAAGUCGAGGAAGTT | 3899 |
| 371 | GUCAGAGAGCGCGUCGGCGUG | 2599 | 36019 | VEGF:371U21 sense siNA stab00 | CAGAGAGAGCGCGUCGGCGTT | 3900 |
| 484 | GCAGCUGACCAGUCCGCUGACG | 2600 | 36020 | VEGF:484U21 sense siNA stab00 | AGCUGACCAGUCCGCUGATT | 3901 |
| 598 | GCCGGAGCCCGCGCCCCGAGGC | 2601 | 36021 | VEGF:598U21 sense siNA stab00 | CCGGAGCCCGCGCCCGGAGTT | 3902 |
| 599 | CCGGAGCCCGCGCCCCGAGGCG | 2602 | 36022 | VEGF:599U21 sense siNA stab00 | CGGAGCCCGCGCCCCGGAGTT | 3903 |
| 600 | CCGGAGCCCGCGCCCCGAGGCGG | 2603 | 36023 | VEGF:600U21 sense siNA stab00 | GGAGCCCGCGCCCCGGAGGTT | 3904 |
| 652 | CACUGAAACUUUUCGUCCAACUU | 2604 | 36024 | VEGF:652U21 sense siNA stab00 | CUGAAACUUUUCGUCCAACTT | 3905 |
| 653 | ACUGAAACUUUUCGUCCAACUUC | 2605 | 36025 | VEGF:653U21 sense siNA stab00 | UGAAACUUUUCGUCCAACUTT | 3906 |
| 654 | CUGAAACUUUUCGUCCAACUUCU | 2606 | 36026 | VEGF:654U21 sense siNA stab00 | GAAACUUUUCGUCCAACUUTT | 3907 |
| 658 | AACUUUCGUCCAACUUCUGGGC | 2607 | 36027 | VEGF:658U21 sense siNA stab00 | CUUUUCGUCCAACUUCUGGTT | 3908 |
| 672 | CUCUGGGCCUGUUCUCGCUUCGG | 2608 | 36028 | VEGF:672U21 sense siNA stab00 | UCUGGGCUGUUCUCGCUUCGTT | 3909 |
| 674 | UCGGGCCUGUUCUCGCUUCGGAG | 2609 | 36029 | VEGF:674U21 sense siNA stab00 | UGGGCUGUUCUCGCUUCGGTT | 3910 |
| 691 | UCGGGAGCCGUGUCCGCGCCGCC | 2610 | 36030 | VEGF:691U21 sense siNA stab00 | GGAGGAGCCGUGUCCGCGCTT | 3911 |
| 692 | CGGGAGCCGUGUCCGCGCCGCCGG | 2611 | 36031 | VEGF:692U21 sense siNA stab00 | GAGGAGCCGUGUCCGCGCGTT | 3912 |
| 758 | CCGGGAGGAGCCGCAGCCGAGG | 2612 | 36032 | VEGF:758U21 sense siNA stab00 | GGGAGGAGCCGCAGCCGGATT | 3913 |
| 759 | CGGGAGGAGCCGCAGCCGAGGA | 2613 | 36033 | VEGF:759U21 sense siNA stab00 | GGAGGAGCCGCAGCCGGAGTT | 3914 |
| 760 | GGGAGGAGCCGCAGCCGAGGAG | 2614 | 36034 | VEGF:760U21 sense siNA stab00 | GAGGAGCCGCAGCCGGAGGTT | 3915 |
| 795 | GAAGAGAAGGAAGAGGAGAGGG | 2615 | 36035 | VEGF:795U21 sense siNA stab00 | AGAAGAAGGAAGAGGAGAGTT | 3916 |
| 886 | GUGCUCCAGCCGCGCGCUCCCC | 2616 | 36036 | VEGF:886U21 sense siNA stab00 | GCUCCAGCCGCGCGAGCCGCUCTT | 3917 |
| 977 | GCCCCACAGCCCGAGCCGGAGAG | 2617 | 36037 | VEGF:977U21 sense siNA stab00 | CCCACAGCCCGAGCCGGAGTT | 3918 |
| 978 | CCCACAGCCCGAGCCGGAGAGG | 2618 | 36038 | VEGF:978U21 sense siNA stab00 | CCACAGCCCGAGCCGGAGATT | 3919 |
| 1038 | ACCAGAACUUUCUGCUGUCUUG | 2619 | 36039 | VEGF:1038U21 sense siNA stab00 | CAGAACUUUCUGCUGUCUUGTT | 3920 |
| 1043 | GAACUUUCUGCUGUCUUGGGUGC | 2620 | 36040 | VEGF:1043U21 sense siNA stab00 | ACUUUCUGCUGUCUUGGGUTT | 3921 |
| 1049 | UCUGCUGUCUUGGGUGCAUUGGA | 2621 | 36041 | VEGF:1049U21 sense siNA stab00 | UGCUGUCUUGGGUGCAUUGTT | 3922 |
| 1061 | GGUGCAUUGGAGCCUUGCCUUGC | 2622 | 36042 | VEGF:1061U21 sense siNA stab00 | UGCAUUGGAGCCUUGCCUUTT | 3923 |
| 1072 | GCCUUGCCUUGCUGCUCUACCUC | 2623 | 36043 | VEGF:1072U21 sense siNA stab00 | CUUGCCUUGCUGCUCUACCTT | 3924 |
| 1088 | UCACCUCCACCAUGCCAAGUGGU | 2624 | 36044 | VEGF:1088U21 sense siNA stab00 | ACCUCCACCAUGCCAAGUGTT | 3925 |
| 1089 | CACCUCCACCAUGCCAAGUGGUC | 2625 | 36045 | VEGF:1089U21 sense siNA stab00 | CCUCCACCAUGCCAAGUGGTT | 3926 |
| 1095 | CACCAUGCCAAGUGGUCCCAGGC | 2626 | 36046 | VEGF:1095U21 sense siNA stab00 | CAUGCCAAGUGGUCCCAGTT | 3927 |
| 1110 | UCCCAGGCUGCACCCAUGGCAGA | 2627 | 36047 | VEGF:1110U21 sense siNA stab00 | CCAGGCUGCACCCAUGGCATT | 3928 |
| 1175 | AUUCUACAGCAGCGAGCUACGCC | 2628 | 36048 | VEGF:1175U21 sense siNA stab00 | UCUAUCAGCGCAGUACCUGTT | 3929 |
| 1220 | CAUCUUCAAGCCAUCCUGUGUGC | 2629 | 36049 | VEGF:1220U21 sense siNA stab00 | UCUUCCAGGAGUACCCUGUTT | 3930 |
| 1253 | CAUCUUCAAGCCAUCCUGUGUGU | 2630 | 36050 | VEGF:1253U21 sense siNA stab00 | AAUGACGAGGGCCUGGAGUTT | 3931 |
| 1300 | CUAAUGACGAGGGCCUGGAGUGU | 2631 | 36051 | VEGF:1300U21 sense siNA stab00 | AAUGACGAGGGCCUGGAGUTT | 3932 |
| 1309 | CGGGCCUGGAGUGUGUGCCCACU | 2632 | 36052 | VEGF:1309U21 sense siNA stab00 | GGCCUGGAGUGUGUGCCCATT | 3933 |
| 1326 | CCCACUGAGGAGUCCAACAUCAC | 2633 | 36053 | VEGF:1326U21 sense siNA stab00 | CACUGAGGAGUCCAACAUCTT | 3934 |
| 1338 | UCCAACAUCACCAUGCAGAUUAU | 2634 | 36054 | VEGF:1338U21 sense siNA stab00 | CAACAUCACCAUGCAGAUUTT | 3935 |
| 1342 | ACAUCACCAUGCAGAUUAUGCGG | 2635 | 36055 | VEGF:1342U21 sense siNA stab00 | AUCACCAUGCAGAUUAUGCTT | 3936 |
| 1351 | UGCAGAUUAUGCGGAUCAAACCU | 2636 | 36056 | VEGF:1351U21 sense siNA stab00 | CAGAUUAUGCGGAUCAAACTT | 3937 |
| 1352 | GCAGAUUAUGCGGAUCAAACCUC | 2637 | 36057 | VEGF:1352U21 sense siNA stab00 | AGAUUAUGCGGAUCAAACCTT | 3938 |
| 1353 | CAGAUUAUGCGGAUCAAACCUCA | 2638 | 36058 | VEGF:1353U21 sense siNA stab00 | GAUUAUGCGGAUCAAACCUTT | 3939 |
| 1389 | AUAGGAGAGAGCUUCCUACA | 2639 | 36059 | VEGF:1389U21 sense siNA stab00 | AGGAGAGAUGAGCUUCCUATT | 3940 |
| 1398 | GAGAGCUUCCUACACCAACAA | 2640 | 36060 | VEGF:1398U21 sense siNA stab00 | GAGCUUCCUACACCAACAATT | 3941 |
| 1401 | AGCUUCCUACACCAACAAAUG | 2641 | 36061 | VEGF:1401U21 sense siNA stab00 | CUUCCUACACCAACAAAATT | 3942 |
| 1407 | CCACAGCACACAACAAAUGUGAAUG | 2642 | 36062 | VEGF:1407U21 sense siNA stab00 | ACAGCACACAACAAAUGUGATT | 3943 |
| 1408 | CACAGCACACAACAAAUGUGAAUGC | 2643 | 36063 | VEGF:1408U21 sense siNA stab00 | CAGCACACAACAAAUGUGAAUTT | 3944 |
| 1417 | ACAAAUGUGAAUGCAGACCAAAG | 2644 | 36064 | VEGF:1417U21 sense siNA stab00 | AAAUGUGAAUGCAGACCATT | 3945 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 162 | UCCCUCUUCUUUUUCUUAAACA | 2582 | 36065 | VEGF:180L21 antisense siNA (162 C.) stab00 | UUUAAGAAAAAAGAGAGAGGUU | 3946 |
| 163 | CCCUCUUCUUUUUCUUAAACAU | 2583 | 36066 | VEGF:181L21 antisense siNA (163 C.) stab00 | GUUUAAGAAAAAAGAGAAGAGUU | 3947 |
| 164 | CCUCUUCUUUUUCUUAAACAUU | 2584 | 36067 | VEGF:182L21 antisense siNA (164 C.) stab00 | UGUUUAAGAAAAAAGAAGAGAUU | 3948 |
| 166 | UCUUCUUUUUCUUAAACAUUUU | 2585 | 36068 | VEGF:184L21 antisense siNA (166 C.) stab00 | AAUGUUUAAGAAAAAAGAAAUU | 3949 |
| 169 | UCUUUUUCUUAAACAUUUUUUU | 2586 | 36069 | VEGF:187L21 antisense siNA (169 C.) stab00 | AAAAAAAUGUUUAAGAAAAAUU | 3950 |
| 171 | UUUUUCUUAAACAUUUUUUUUU | 2587 | 36070 | VEGF:189L21 antisense siNA (171 C.) stab00 | AAAAAAAAUGUUUAAGAAAAUU | 3951 |
| 172 | UUUUCUUAAACAUUUUUUUUUA | 2588 | 36071 | VEGF:190L21 antisense siNA (172 C.) stab00 | ACAGUUUUAAAAAAAAUGUU | 3952 |
| 181 | AACAAACUGUAAUGUGUAU | 2589 | 36072 | VEGF:199L21 antisense siNA (181 C.) stab00 | AAACAUUUAAAAAAAAAUGUU | 3953 |
| 187 | UUUUUAAAACUGUAAUGUUUC | 2590 | 36073 | VEGF:205L21 antisense siNA (187 C.) stab00 | AACAAUACAGUUUUAAAAAUU | 3954 |
| 188 | UUUUAAAACUGUAUGUUUCU | 2591 | 36074 | VEGF:206L21 antisense siNA (188 C.) stab00 | AAACAAUACAGUUUUAAAAUU | 3955 |
| 192 | UAAAACUGUAUGUUUCUGU | 2592 | 36075 | VEGF:210L21 antisense siNA (192 C.) stab00 | CGAGAAACAAUACAGUUUUUU | 3956 |
| 202 | AUGUUUCUGUUUUAAUUAUU | 2593 | 36076 | VEGF:220L21 antisense siNA (202 C.) stab00 | UAAAUUAAAACGAGAAACAUU | 3957 |
| 220 | UAUUUUCUUGCCAAUCCCCA | 2594 | 36077 | VEGF:238L21 antisense siNA (220 C.) stab00 | GGGAAUGGCAAGCAAAAAUU | 3958 |
| 237 | UCCCACUGAAUCGGGCCGACG | 2595 | 36078 | VEGF:255L21 antisense siNA (237 C.) stab00 | UCGGCCCGAUUCAGUGGGUU | 3959 |
| 238 | CCCACUGAAUCGGGCCGACGG | 2596 | 36079 | VEGF:256L21 antisense siNA (238 C.) stab00 | GUCGGCCCGAUUCAGUGGUU | 3960 |
| 338 | UCCAGAGAAGUCGAGGAAGA | 2597 | 36080 | VEGF:356L21 antisense siNA (338 C.) stab00 | UCCUUCGACUUCUCUCUGGUU | 3961 |
| 339 | CCAGAGAAGUCGAGGAAGAG | 2598 | 36081 | VEGF:357L21 antisense siNA (339 C.) stab00 | CUUCCUUCGACUUCUCUCUGUU | 3962 |
| 371 | GUCAGAGAGCGCGCGGCGUG | 2599 | 36082 | VEGF:389L21 antisense siNA (371 C.) stab00 | CGCCGCGCGCUCUCUGACUU | 3963 |
| 484 | GCAGCUGACCAGUCGCGCUGACG | 2600 | 36083 | VEGF:502L21 antisense siNA (484 C.) stab00 | UCAGCGCGACUGGUCAGCUUU | 3964 |
| 598 | GGCCGGAGCCCGCGCCCGGAGGC | 2601 | 36084 | VEGF:616L21 antisense siNA (598 C.) stab00 | CUCCGGGCGCGGGCUCCGGUU | 3965 |
| 599 | GCCGGAGCCCGCGCCCGGAGGCG | 2602 | 36085 | VEGF:617L21 antisense siNA (599 C.) stab00 | CCUCCGGGCGCGGGCUCCGUU | 3966 |
| 600 | CCGGAGCCCGCGCCGGAGGCGG | 2603 | 36086 | VEGF:618L21 antisense siNA (600 C.) stab00 | GCCUCCGGGCGCGGGCUCCUU | 3967 |
| 652 | CACUGAAACUUUUCGUCCAACUU | 2604 | 36087 | VEGF:670L21 antisense siNA (652 C.) stab00 | GUUGGACGAAAAGUUUCAGUU | 3968 |
| 653 | ACUGAAACUUUUCGUCCAACUUC | 2605 | 36088 | VEGF:671L21 antisense siNA (653 C.) stab00 | AGUUGGACGAAAAGUUUCAUU | 3969 |
| 654 | CUGAAACUUUUCGUCCAACUUCU | 2606 | 36089 | VEGF:672L21 antisense siNA (654 C.) stab00 | AAGUUGGACGAAAAGUUCUU | 3970 |
| 658 | AACUUUUCGUCCAACUUCUGGGC | 2607 | 36090 | VEGF:676L21 antisense siNA (658 C.) stab00 | CCAGAAGUUGGACGAAAAGUU | 3971 |
| 672 | CUUCUGGGCUGUCUGGUCUCG | 2608 | 36091 | VEGF:690L21 antisense siNA (672 C.) stab00 | GAAGCGAGAACAGCCCAGAUU | 3972 |
| 674 | UCUGGGCUGUCUUCGUCUCGGAG | 2609 | 36092 | VEGF:692L21 antisense siNA (674 C.) stab00 | CCGAAGCGAGAACAGCCCAUU | 3973 |
| 691 | CGGAGGAGGAGCCGCAGCCGG | 2611 | 36093 | VEGF:709L21 antisense siNA (691 C.) stab00 | CGGCCACGGCUGCUCCUCCUU | 3974 |
| 692 | CGGAGGAGCGCGUGGCCGCGG | 2612 | 36094 | VEGF:710L21 antisense siNA (692 C.) stab00 | GCGCGGACCACGCGCUCCUUU | 3975 |
| 758 | CCGGGAGGAGCCCGAGCCGG | 2613 | 36095 | VEGF:776L21 antisense siNA (758 C.) stab00 | UCCGGCUCGGCGCUCCUCCUU | 3976 |
| 759 | CGGGAGGAGGCGCCAGCCGGAGA | 2614 | 36096 | VEGF:777L21 antisense siNA (759 C.) stab00 | CUCCGGCUGCGCCUCCUCUUU | 3977 |
| 760 | GGGAGGAGGCGCAGCCGGAGAG | 2615 | 36097 | VEGF:778L21 antisense siNA (760 C.) stab00 | CCUCCGGCUGCGCCUCCUCUU | 3978 |
| 795 | GAAGAGAGAGGAGAGGCGCGCGG | 2616 | 36098 | VEGF:813L21 antisense siNA (795 C.) stab00 | CCUCGCCUCCUCCUUUCUCUUU | 3979 |
| 886 | GUGUCCAGCGCGCGCCUCCC | 2617 | 36099 | VEGF:904L21 antisense siNA (886 C.) stab00 | GAGCGCGCGCGGCUGGAGUU | 3980 |
| 977 | GCCCACAGCCCGAGCGGAGAG | 2618 | 36100 | VEGF:995L21 antisense siNA (977 C.) stab00 | CUCCGCUCGGGCUGUGGGUU | 3981 |
| 978 | CCCACAGCCCGAGCGGAGAGG | 2619 | 36101 | VEGF:996L21 antisense siNA (978 C.) stab00 | UCUCCGCUCGGCUGUGGGUU | 3982 |
| 1038 | ACCAUGAACUUUCUGCUGUCUUG | 2620 | 36102 | VEGF:1056L21 antisense siNA (1038 C.) stab00 | AGACAGCAGAAAGUUCAUGUU | 3983 |
| 1043 | GAACUUUCUGCUGUCUUGGGU | 2621 | 36103 | VEGF:1061L21 antisense siNA (1043 C.) stab00 | ACCCAAGACAGCAGAAAGUUU | 3984 |
| 1049 | UCUGCUGUCUUGGGUGCAUUGGA | 2622 | 36104 | VEGF:1067L21 antisense siNA (1049 C.) stab00 | CAAUGCACCCAAGACAGCAUU | 3985 |
| 1061 | GGUGCAUUGGAGCCUUGCCUUGC | 2623 | 36105 | VEGF:1079L21 antisense siNA (1061 C.) stab00 | AAGGCAAGGCUCCAAUGCAUU | 3986 |
| 1072 | UCACCUUCCACCAUGCCAAGU | 2624 | 36106 | VEGF:1090L21 antisense siNA (1072 C.) stab00 | GGUAGAGCAGCAAGGCAAGUU | 3987 |
| 1088 | CUCUCCACCAUGCCAAGUGGU | 2625 | 36107 | VEGF:1106L21 antisense siNA (1088 C.) stab00 | CACUUGGCAUGGUGGAGUU | 3988 |
| 1089 | CUCCCACCAUGCCAAGUGGUC | 2626 | 36108 | VEGF:1107L21 antisense siNA (1089 C.) stab00 | CCACUUGGCAUGGUGGAGGUU | 3989 |
| 1095 | CCAUGCCAAGUGGCCCAGGC | 2627 | 36109 | VEGF:1113L21 antisense siNA (1095 C.) stab00 | CUGGGACCACUUGGCAUGGUU | 3990 |
| 1110 | CAGGCCUGCACCCAGGCAGA | 2628 | 36110 | VEGF:1128L21 antisense siNA (1110 C.) stab00 | UGCCUGGGUGCAGCCUGGUU | 3991 |
| 1175 | AUUCUAUCGGCAGCUACUGCC | 2629 | 36111 | VEGF:1193L21 antisense siNA (1175 C.) stab00 | CAGUAGCUGCCGCUAUGAUU | 3992 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1220 | CAUCUUCCAGGAGUACCCUGAUG | 2629 | 36112 | VEGF:1238L21 antisense siNA (1220 C.) stab00 | UCAGGGUACUCCUGAAGAUU | 3993 |
| 1253 | CAUCUUCAAGCCAUCCUGAGUGC | 2630 | 36113 | VEGF:1271L21 antisense siNA (1253 C.) stab00 | ACACAGGAUGGCUUGAAGAUU | 3994 |
| 1300 | CUAAUGACGAGGGCCUGGAGUGU | 2631 | 36114 | VEGF:1318L21 antisense siNA (1300 C.) stab00 | ACUCCAGGCCCUCGUCAUUUU | 3995 |
| 1309 | CGGGCCUGGAGUGUGUGCCACU | 2632 | 36115 | VEGF:1327L21 antisense siNA (1309 C.) stab00 | UGGGCACACACUCCAGGCCUU | 3996 |
| 1326 | CCCACUGAGGAGUCCAACAUCAC | 2633 | 36116 | VEGF:1344L21 antisense siNA (1326 C.) stab00 | GAUGUUGGACUCCUCAGUGUU | 3997 |
| 1338 | AGCUCAUCACAGCAAUUAUGCGG | 2634 | 36117 | VEGF:1356L21 antisense siNA (1338 C.) stab00 | AAUUGCAGGGUGAUGUUGUU | 3998 |
| 1342 | UCCAACAUCACCAUGCAGAUUAU | 2635 | 36118 | VEGF:1360L21 antisense siNA (1342 C.) stab00 | GCAUAAUCUGCAUGGUGAUUU | 3999 |
| 1351 | ACAUCACCAUGCAGAUUAUGCGG | 2636 | 36119 | VEGF:1369L21 antisense siNA (1351 C.) stab00 | GUUUGAUCCGAUAAUCUGUU | 4000 |
| 1352 | UGCAGAUUAUGCGGAUCAAACCU | 2637 | 36120 | VEGF:1370L21 antisense siNA (1352 C.) stab00 | GGUUUGAUCCGCAUAAUCUUU | 4001 |
| 1353 | GCAGAUUAUGCGGAUCAAACCUC | 2638 | 36121 | VEGF:1371L21 antisense siNA (1353 C.) stab00 | AGGUUUGAUCCGCAUAAUCUU | 4002 |
| 1389 | CAGAUUAUGCGGAUCAAACCUCA | 2639 | 36122 | VEGF:1407L21 antisense siNA (1389 C.) stab00 | UAGGAAGCUCAUUAGGGAAGCUCUU | 4003 |
| 1398 | AUAGGAGAGAUGAGCUUCCUACA | 2640 | 36123 | VEGF:1416L21 antisense siNA (1398 C.) stab00 | GUUGUGCUGUAGGAAGCUCUU | 4004 |
| 1401 | GAGAGCUUCCUACAGCACAACAA | 2641 | 36124 | VEGF:1419L21 antisense siNA (1401 C.) stab00 | UUUGUUGCUGUAGGAAGUU | 4005 |
| 1407 | AGCUUCCUACAGCACAACAAAUG | 2642 | 36125 | VEGF:1425L21 antisense siNA (1407 C.) stab00 | UUCACAUUUGUUGUGCUGUU | 4006 |
| 1408 | CCAGCACAACAAAUGUGAAUG | 2643 | 36126 | VEGF:1426L21 antisense siNA (1408 C.) stab00 | AUUCACAUUUGUUGCGUGUU | 4007 |
| 1417 | UACAGCACAACAAAUGUGAAUGC | 2644 | 36127 | VEGF:1435L21 antisense siNA (1417 C.) stab00 | UUGGUCUGCAUUCACAUUUU | 4008 |
| 1089 | ACAAAUUGAAUGCAGACCAAAAG | 2645 | 37293 | VEGF:1089U21 sense siNA stab07 | B cuccAccAuGccAAGuGGUU | 4009 |
| 1090 | UACCUCCACCAUGCCAAGUGGUC | 2646 | 37294 | VEGF:1090U21 sense siNA stab07 | B cuccAccAuGccAAGuGGuUU | 4010 |
| 1095 | ACCUCCACCAUGCCAAGUGGUCC | 2626 | 37295 | VEGF:1095U21 sense siNA stab07 | B ccAuGccAAGuGGuccccAGUU | 4011 |
| 1096 | CACCAUGCCAAGUGGUCCCAGGC | 2647 | 37296 | VEGF:1096U21 sense siNA stab07 | B cAuGccAAGuGGuccccAGGUU | 4012 |
| 1097 | ACCAUGCCAAGUGGUCCCAGGCU | 2648 | 37297 | VEGF:1097U21 sense siNA stab07 | B AuGccAAGuGGuccccAGGcUU | 4013 |
| 1098 | CCAUGCCAAGUGGUCCCAGGCUG | 2649 | 37298 | VEGF:1098U21 sense siNA stab07 | B uGccAAGuGGuccccAGGcuUU | 4014 |
| 1099 | AUGCCAAGUGGUCCCAGGCUGCA | 2650 | 37299 | VEGF:1099U21 sense siNA stab07 | B GccAAGuGGuccccAGGcuGUU | 4015 |
| 1100 | UGCCAAGUGGUCCCAGGCUGCAC | 2651 | 37300 | VEGF:1100U21 sense siNA stab07 | B ccAAGuGGuccccAGGcuGcUU | 4016 |
| 1104 | AGUGGUCCCAGGCUGCACCCAU | 2652 | 37301 | VEGF:1104U21 sense siNA stab07 | B GuGGuccccAGGcuGcAcccUU | 4017 |
| 1105 | GUGGUCCCAGGCUGCACCCAUG | 2653 | 37302 | VEGF:1105U21 sense siNA stab07 | B uGGuccccAGGcuGcAcccAUU | 4018 |
| 1208 | AGUCCUGGGAGACAUCUUCCAGG | 2562 | 37303 | VEGF:1208U21 sense siNA stab07 | B cccuGGuGGAcAucuuccAUU | 4019 |
| 1424 | UGAAUGCAGACCAAAGAAAGAUA | 2654 | 37304 | VEGF:1424U21 sense siNA stab07 | B AAuGcAGAccAAAGAAAGAUU | 4020 |
| 1549 | GCUCAGAGCGGAGAAAGCAUUUG | 2655 | 37305 | VEGF:1549U21 sense siNA stab07 | B ucAGAGccGGAGAAAGcAuUU | 4021 |
| 1584 | CCCGACGUAAAUGUUCCUG | 2565 | 37306 | VEGF:1584U21 sense siNA stab07 | B GcAGAcGuUAAAuGuuccUUU | 4022 |
| 1585 | CCGACGUAAAUGUUCCUGCAAA | 2566 | 37307 | VEGF:1585U21 sense siNA stab07 | B cAGAcGuAAAuGuuccuGcUU | 4023 |
| 1589 | CGGAGCGUAAAUGUUCCUGCAAA | 2567 | 37308 | VEGF:1589U21 sense siNA stab07 | B cGuAAAuGuuccuGcAAAUU | 4024 |
| 1591 | GCAGUAAAUGUUCCUGCAAAAAC | 2554 | 37309 | VEGF:1591U21 sense siNA stab07 | B uGuAAAuGuuccuGcAAAAUU | 4025 |
| 1592 | CGGUAAAUGUUCCUGCAAAAACA | 2555 | 37310 | VEGF:1592U21 sense siNA stab07 | B GuAAAuGuUAAAuGuccuUU | 4026 |
| 1593 | UGUAAAUGUUCCUGCAAAAACAC | 2556 | 37311 | VEGF:1593U21 sense siNA stab07 | B uAAAuGuuccuGcAAAAAcUU | 4027 |
| 1594 | GUAAAUGUUCCUGCAAAACACA | 2557 | 37312 | VEGF:1594U21 sense siNA stab07 | B AAAuGuuccuGcAAAAAcAUU | 4028 |
| 1595 | UAAAUGUUCCUGCAAAAACACAG | 2568 | 37313 | VEGF:1595U21 sense siNA stab07 | B AAuGuuccuGcAAAAAcAcUU | 4029 |
| 1597 | AAUGUUCCUGCAAAAACACAGAC | 2656 | 37314 | VEGF:1597U21 sense siNA stab07 | B uGuuccuGcAAAAAcAcAGUU | 4030 |
| 1598 | AUGUUCCUGCAAAAACACAGACU | 2657 | 37315 | VEGF:1598U21 sense siNA stab07 | B GuuccuGcAAAAAcAcAGAUU | 4031 |
| 1599 | UGUUCCUGCAAAAACACAGACUC | 2658 | 37316 | VEGF:1599U21 sense siNA stab07 | B uuccuGcAAAAAcAcAGAcUU | 4032 |
| 1600 | GUUCCUGCAAAAACACAGACUCG | 2659 | 37317 | VEGF:1600U21 sense siNA stab07 | B uccuGcAAAAAcAcAGAcUcUU | 4033 |
| 1604 | CUGCAAAAACACAGACUCGCGUU | 2558 | 37318 | VEGF:1604U21 sense siNA stab07 | B GcAAAAAcAcAGAcucGcGUU | 4034 |
| 1605 | UGCAAAAACACAGACUCGCGUUG | 2660 | 37319 | VEGF:1605U21 sense siNA stab07 | B cAAAAAcAcAGAcucGcGuUU | 4035 |
| 1608 | AAAAACACAGACUCGCGUUGCAA | 2661 | 37320 | VEGF:1608U21 sense siNA stab07 | B AAAcAcAGAcucGcGuuGcUU | 4036 |
| 1612 | ACACAGACUCGCGUUGCAAGGCG | 2662 | 37321 | VEGF:1612U21 sense siNA stab07 | B AcAGAcucGcGuuGcAAGGUU | 4037 |
| 1616 | AGACUCGCGUUGCAAGGCGAGGC | 2663 | 37322 | VEGF:1616U21 sense siNA stab07 | B AcucGcGuuGcAAGGcGAGUU | 4038 |
| 1622 | GCGUUGCAAGGCGAGGCAGCUUG | 2664 | 37323 | VEGF:1622U21 sense siNA stab07 | B GuuGcAAGGcGAGGcAGcuUU | 4039 |

TABLE III-continued

VEGF and/or VEGFR Synthetic Modified siNA Constructs

| Target Pos | Target | Seq ID | Cmpd # | Aliases | | Sequence | Seq ID |
|---|---|---|---|---|---|---|---|
| 1626 | UGCAAGGCGAGGCAGCUUGAGUU | 2665 | 37324 | VEGF:1626U21 sense siNA stab07 | | B cAAGGcGAGGcAGcuuGAGuTT | 4040 |
| 1628 | CAAGGCGAGGCAGCUUGAGUUAA | 2666 | 37325 | VEGF:1628U21 sense siNA stab07 | | B AGGcGAGGcAGcuuGAGuuAAcGTT | 4041 |
| 1633 | CGAGGCAGCUUGAGUUAACGAAC | 2573 | 37326 | VEGF:1633U21 sense siNA stab07 | | B AGGcAGcuuGAGuuAAcGAAcGTT | 4042 |
| 1634 | GAGGCAGCUUGAGUUAACGAACG | 2574 | 37327 | VEGF:1634U21 sense siNA stab07 | | B GGcAGcuuGAGuuAAAcGAATT | 4043 |
| 1635 | AGGCAGCUUGAGUUAAACGAACA | 2575 | 37328 | VEGF:1635U21 sense siNA stab07 | | B GcAGcuuGAGuuAAAcGAATT | 4044 |
| 1637 | GCAGCUUGAGUUAAACGAACGUA | 2559 | 37329 | VEGF:1637U21 sense siNA stab07 | | B AGcuuGAGuuAAAcGAAcGTT | 4045 |
| 1643 | UGAGUUAACGAACGUACUUGCA | 2667 | 37330 | VEGF:1643U21 sense siNA stab07 | | B AGuuAAcGAAcGuAcuuGcATT | 4046 |
| 1645 | AGUUAAACGAACGUACUUGCAGA | 2668 | 37331 | VEGF:1645U21 sense siNA stab07 | | B uuAAAcGAAcGuAcuuGcAGTT | 4047 |
| 1646 | GUUAAACGAACGUACUUGCAGAU | 2669 | 37332 | VEGF:1646U21 sense siNA stab07 | | B uAAAcGAAcGuAcuuGcAGTT | 4048 |
| 1647 | UUAAACGAACGUACUUGCAGAUG | 2670 | 37333 | VEGF:1647U21 sense siNA stab07 | | B AAAcGAAcGuAcuuGcAGAUTT | 4049 |
| 1648 | UAAACGAACGUACUUGCAGAUGU | 2577 | 37334 | VEGF:1648U21 sense siNA stab07 | | B AAcGAACGuAcuuGcAGAuTT | 4050 |
| 1655 | ACGUACUUGCAGAUGUGACAAGC | 2671 | 37335 | VEGF:1655U21 sense siNA stab07 | | B GuAcuuGcAGAuGuGAcAATT | 4051 |
| 1656 | CGUACUUGCAGAUGUGACAAGCC | 2560 | 37336 | VEGF:1656U21 sense siNA stab07 | | B uAcuuGcAGAuGuGAcAAGcTT | 4052 |
| 1657 | GUACUUGCAGAUGUGACAAGCCG | 2672 | 37337 | VEGF:1657U21 sense siNA stab07 | | B AcuuGcAGAuGuGAcAAGcTT | 4053 |
| 1089 | UACCUCCACUGCCAAGUGGUC | 2645 | 37338 | VEGF:1107L21 antisense siNA (1089 C.) stab26 | | CCAcuuGGcAuGuGGAGTT | 4054 |
| 1090 | ACCUCCACUGCCAAGUGGUCC | 2646 | 37339 | VEGF:1108L21 antisense siNA (1090 C.) stab26 | | ACCAcuuGGcAuGGGAGTT | 4055 |
| 1095 | CCAUGCCAAGUGGUCCCAGGC | 2626 | 37340 | VEGF:1113L21 antisense siNA (1095 C.) stab26 | | CUGGGAccAcuuGGcAuGTT | 4056 |
| 1096 | CAUGCCAAGUGGUCCCAGGCU | 2647 | 37341 | VEGF:1114L21 antisense siNA (1096 C.) stab26 | | CCUGGGAccAcuuGGcAuGTT | 4057 |
| 1097 | AUGCCAAGUGGUCCCAGGCUG | 2648 | 37342 | VEGF:1115L21 antisense siNA (1097 C.) stab26 | | GCCuGGGAccAcuuGGcATT | 4058 |
| 1098 | UGCCAAGUGGUCCCAGGCUGC | 2649 | 37343 | VEGF:1116L21 antisense siNA (1098 C.) stab26 | | AGCcuGGGAccAcuuGGcTT | 4059 |
| 1099 | GCCAAGUGGUCCCAGGCUGCA | 2650 | 37344 | VEGF:1117L21 antisense siNA (1099 C.) stab26 | | CAGccuGGGAccAcuuGGTT | 4060 |
| 1100 | CCAAGUGGUCCCAGGCUGCAC | 2651 | 37345 | VEGF:1118L21 antisense siNA (1100 C.) stab26 | | GCAGccuGGGAccAcuuGTT | 4061 |
| 1104 | GUGGUCCCAGGCUGCACCCAU | 2652 | 37346 | VEGF:1122L21 antisense siNA (1104 C.) stab26 | | GGGuGcAGccuGGGAccAcTT | 4062 |
| 1105 | UGGUCCCAGGCUGCACCCAUG | 2653 | 37347 | VEGF:1123L21 antisense siNA (1105 C.) stab26 | | UGGGuGcAGccuGGGAccATT | 4063 |
| 1208 | GACCCAGACCAUCUUCCAGG | 2562 | 37348 | VEGF:1226L21 antisense siNA (1208 C.) stab26 | | UGGAAGAuGGucAccAGGGTT | 4064 |
| 1214 | GGUGGAACAUCUUCCAGGAGUACC | 2542 | 37349 | VEGF:1232L21 antisense siNA (1214 C.) stab26 | | uAcuccuGGAAGAuGuccATT | 4065 |
| 1421 | AUGUGAAUGCAGACCAAAGAAAG | 2551 | 37350 | VEGF:1439L21 antisense siNA (1421 C.) stab26 | | UUcuuGGucuGcAuucAcTT | 4066 |
| 1423 | GUGAAUGCAGACCAAAGAAGAU | 2552 | 37351 | VEGF:1441L21 antisense siNA (1423 C.) stab26 | | CUUucuuuGGucuGcAuucTT | 4067 |
| 1424 | UGAAUGCAGACCAAAGAAAGAUA | 2654 | 37352 | VEGF:1442L21 antisense siNA (1424 C.) stab26 | | UCUucuuuGGucuGcAuuTT | 4068 |
| 1549 | GCUCAGAGCGGAGAAAGCAUUUG | 2655 | 37353 | VEGF:1567L21 antisense siNA (1549 C.) stab26 | | AAUGcuuucuccGcucuGATT | 4069 |
| 1584 | CCCGCAGACGUGUAAAUGUUCCUG | 2565 | 37354 | VEGF:1602L21 antisense siNA (1584 C.) stab26 | | GGAAcAuuuAcAcGucuGcTT | 4070 |
| 1585 | CGCAGACGUGUAAAUGUUCCUGC | 2566 | 37355 | VEGF:1603L21 antisense siNA (1585 C.) stab26 | | AGGAAcAuuuAcAcGucuGTT | 4071 |
| 1589 | GACGUGUAAAUGUUCCUGCAAA | 2567 | 37356 | VEGF:1607L21 antisense siNA (1589 C.) stab26 | | UUGcAGGAAcAuuuAcAcGTT | 4072 |
| 1591 | CGUGUAAAUGUUCCUGCAAAAAC | 2554 | 37357 | VEGF:1609L21 antisense siNA (1591 C.) stab26 | | UUUuGcAGGAAcAuuuAcATT | 4073 |
| 1592 | GUGUAAAUGUUCCUGCAAAAACA | 2555 | 37358 | VEGF:1610L21 antisense siNA (1592 C.) stab26 | | UUuuGcAGGAAcAuuuAcTT | 4074 |
| 1593 | UGUAAAUGUUCCUGCAAAAACAC | 2556 | 37359 | VEGF:1611L21 antisense siNA (1593 C.) stab26 | | GUUuuuGcAGGAAcAuuuATT | 4075 |
| 1594 | GUAAAUGUUCCUGCAAAAACACA | 2557 | 37360 | VEGF:1612L21 antisense siNA (1594 C.) stab26 | | UGUuuuuGcAGGAAcAuuuTT | 4076 |
| 1595 | UAAAUGUUCCUGCAAAAACACAG | 2568 | 37361 | VEGF:1613L21 antisense siNA (1595 C.) stab26 | | GUGuuuuuGcAGGAAcAuTT | 4077 |
| 1597 | AAUGUUCCUGCAAAAACACAGAC | 2656 | 37362 | VEGF:1615L21 antisense siNA (1597 C.) stab26 | | CUGuGuuuuuGcAGGAAcATT | 4078 |
| 1598 | AUGUUCCUGCAAAAACACAGACU | 2657 | 37363 | VEGF:1616L21 antisense siNA (1598 C.) stab26 | | UCUGuGuuuuuGcAGGAAcTT | 4079 |
| 1599 | UGUUCCUGCAAAAACACAGACUC | 2658 | 37364 | VEGF:1617L21 antisense siNA (1599 C.) stab26 | | GUcuGuGuuuuuGcAGGATT | 4080 |
| 1600 | GUUCCUGCAAAAACACAGACUCG | 2659 | 37365 | VEGF:1618L21 antisense siNA (1600 C.) stab26 | | AGUcuGuGuuuuuGcAGGATT | 4081 |
| 1604 | CUGCAAAAACACAGACUCGCGUU | 2558 | 37366 | VEGF:1622L21 antisense siNA (1604 C.) stab26 | | CGCGAGucuGuGuuuuuGcTT | 4082 |
| 1605 | UGCAAAAACACAGACUCGCGUUG | 2660 | 37367 | VEGF:1623L21 antisense siNA (1605 C.) stab26 | | ACGcGAGucuGuGuuuuuGTT | 4083 |
| 1608 | AAAAACACAGACUCGCGUUGCAA | 2661 | 37368 | VEGF:1626L21 antisense siNA (1608 C.) stab26 | | GCAACGcGAGucuGuGuuuTT | 4084 |
| 1612 | ACACAGACUCGCGUUGCAAGGCG | 2662 | 37369 | VEGF:1630L21 antisense siNA (1612 C.) stab26 | | CCUuGcAAcGcGAGucuGuTT | 4085 |
| 1616 | AGACUCGCGUUGCAAGGCGAGGC | 2663 | 37370 | VEGF:1634L21 antisense siNA (1616 C.) stab26 | | CUGccuuGcAAcGcGAGuTT | 4086 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1622 | GCGUUGCAAGGCCAGGCAGCUUG | 2664 | 37371 | VEGF:1640L21 antisense siNA (1622 C.) stab26 | AGCuGccucGccuuGcAAcTT | 4087 |
| 1626 | UGCAAGGCCAGGCAGCUUGAGUU | 2665 | 37372 | VEGF:1644L21 antisense siNA (1626 C.) stab26 | CUCAAGcuGccucGccuuGTT | 4088 |
| 1628 | CAAGGCCAGGCAGCUUGAGUUAA | 2666 | 37373 | VEGF:1646L21 antisense siNA (1628 C.) stab26 | AACucAAGcuGccucGccuTT | 4089 |
| 1633 | CGAGGCAGCUUGAGUUAAACGAA | 2573 | 37374 | VEGF:1651L21 antisense siNA (1633 C.) stab26 | CGUuuAAcucAAGcuGccuTT | 4090 |
| 1634 | GAGGCAGCUUGAGUUAAACGAAC | 2574 | 37375 | VEGF:1652L21 antisense siNA (1634 C.) stab26 | UCGuuuAAcucAAGcuGccTT | 4091 |
| 1635 | AGGCAGCUUGAGUUAAACGAACG | 2575 | 37376 | VEGF:1653L21 antisense siNA (1635 C.) stab26 | UUCGuuuAAcucAAGcuGcTT | 4092 |
| 1636 | GGCAGCUUGAGUUAAACGAACGU | 2576 | 37377 | VEGF:1654L21 antisense siNA (1636 C.) stab26 | GUUcGuuuAAcucAAGcuGTT | 4093 |
| 1637 | GCAGCUUGAGUUAAACGAACGUA | 2559 | 37378 | VEGF:1655L21 antisense siNA (1637 C.) stab26 | CGUucGuuuAAcucAAGcuTT | 4094 |
| 1643 | UGAGUUAAACGAACGUACUUGCA | 2667 | 37379 | VEGF:1661L21 antisense siNA (1643 C.) stab26 | CAAGuAcGuucGuuuAAcuTT | 4095 |
| 1645 | AGUUAAACGAACGUACUUGCAGA | 2668 | 37380 | VEGF:1663L21 antisense siNA (1645 C.) stab26 | UCuGcAAGuAcGuucGuuuATT | 4096 |
| 1646 | GUUAAACGAACGUACUUGCAGAU | 2669 | 37381 | VEGF:1664L21 antisense siNA (1646 C.) stab26 | CUGcAAGuAcGuucGuuuATT | 4097 |
| 1647 | UUAAACGAACGUACUUGCAGAUG | 2670 | 37382 | VEGF:1665L21 antisense siNA (1647 C.) stab26 | UCUGcAAGuAcGuucGuuuTT | 4098 |
| 1648 | UAAACGAACGUACUUGCAGAUGU | 2577 | 37383 | VEGF:1666L21 antisense siNA (1648 C.) stab26 | AUCuGcAAGuAcGuucGuuTT | 4099 |
| 1655 | ACGUACUUGCAGAUGUGACAAGC | 2671 | 37384 | VEGF:1673L21 antisense siNA (1655 C.) stab26 | UUGucAcAucuGcAAGuAcTT | 4100 |
| 1656 | CGUACUUGCAGAUGUGACAAGCC | 2560 | 37385 | VEGF:1674L21 antisense siNA (1656 C.) stab26 | CUUGucAcAucuGcAAGuATT | 4101 |
| 1657 | GUACUUGCAGAUGUGACAAGCCG | 2672 | 37386 | VEGF:1675L21 antisense siNA (1657 C.) stab26 | GCUuGucAcAucuGcAAGuTT | 4102 |
| 1562 | AAAGCAUUUGUUUGUACAAGAUC | 2581 | 37575 | VEGF:1562U21 sense siNA stab07 | B AGcAuuuGuuuGuAcAAGATT B | 4103 |
| 1562 | AAAGCAUUUGUUUGUACAAGAUC | 2581 | 37577 | VEGF:1580L21 antisense siNA (1562 C.) stab26 | UCUuGuAcAAAcAAAuGcuTT | 4104 |
| 1215 | GUGGACAUCUUCCAGGAGUACCC | 2543 | 37789 | VEGF:1233L21 antisense siNA (1215 C.) stab26 | GUAcucCuGGAAGAuGuccTT | 4105 |

VEGF/VEGFR multifunctional siNA

| 1501 | ACCUCACUGCCACUCUAAUUGUC CCUCACUGCCACUCUAAUUGUCA | 2673 | 34692 | F/K bf-1a siNA stab00 [FLT1:1519L21 (1501 C.) −14 + KDR:503U21] | CAAUUAGAGUGGCAGUGAGCAAAGUTC | 4106 |
| 1502 | CCUCACUGCCACUCUAAUUGUCA CCUCACUGCCACUCUAAUUGUCA | 2674 | 34693 | F/K bf-2a siNA stab00 [FLT1:1520L21 (1502 C.) −13 + KDR:503U21] | ACAAUUAGAGUGGCAGUGAGCAAAGTT | 4107 |
| 1503 | CUCACUGCCACUCUAAUUGUCAA CCUCACUGCCACUCUAAUUGUCA | 2675 | 34694 | F/K bf-3a siNA stab00 [FLT1:1521L21 (1503 C.) −12 + KDR:503U21] | GACAAUUAGAGUGGCAGUGAGCAAAGTT | 4108 |
| 3646 | AAAGCAUUUGUUUGUACAAGAUC UCAUGCUGGACUGCUGGCCACAGA | 2676 | 34695 | V/F bf-1a siNA stab00 [FLT1:3664L19 (3646 C.) −5 + VEGF:1562U21] | UGUGCCAGCAGUCCAGCAUUUGUUUGUACAAGATT | 4109 |
| 5353 | AGAGAGACCGGGUCAGAGAGC AAGACCCGCUCUCUACCAACC | 2677 | 34696 | V/F bf-2a siNA stab00 [FLT1:5371L19 (5353 C.) −12 + VEGF:360U21] | UUGGUAUAGAGACCGGGUCAGAGAGATT | 4110 |
| 1501 | ACCUCACUGCCACUCUAAUUGUC UCAGAGUGGCAGUGAGCAAAGGG | 2678 | 34697 | F/K bf-1b siNA stab00 [KDR:521L21 (503 C.) −14 + FLT1:1501U21] | CUUUGCUCACUGCCACUCUAAUUGTT | 4111 |
| 1502 | CCUCACUGCCACUCUAAUUGUCA UCAGAGUGGCAGUGAGCAAAGGG | 2679 | 34698 | F/K bf-2b siNA stab00 [KDR:521L21 (503 C.) −13 + FLT1:1502U21] | CUUUGCUCACUGCCACUCUAAUUGUTT | 4112 |
| 1503 | CUCACUGCCACUCUAAUUGUCAA UCAGAGUGGCAGUGAGCAAAGGG | 2680 | 34699 | F/K bf-3b siNA stab00 [KDR:521L21 (503 C.) −12 + FLT1:1503U21] | CUUUGCUCACUGCCACUCUAAUUGUCTT | 4113 |
| 3646 | AAAGCAUUUGUUUGUACAAGAUC | 2676 | 34700 | V/F bf-1b siNA stab00 | UCUUGUACAAACAAAUGCUGGACUGCUGGCACATT | 4114 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| | UCAUGCUGGACUGCUGGCACAGA | | | [VEGF.1580L19 (1562 C.) −5 + FLT1:3646U21] | UCUCUCUGACCCCGUCUCUAUACCAAUU | 4115 |
| 5353 | AGAGAGACGGGUCAGGAGAGC AAGACCCCGUCUCUAUACCAACC | 2677 | 34701 | V/F bf-2b siNA stab00 [VEGF.378L21 (360 C.) −12 + FLT1:5353U21] | UGUGCCAGUCCAGCAU UGUGAAUGCAGACCAAAGAUU | 4116 |
| 3646 | AAUGUGAAUGCAGACCAAAGAAA UCAUGCUGGACUGCUGGCACAGA | 2681 | 34702 | V/F bf-3a siNA stab00 [FLT1:3664L19 (3646 C.) + VEGF1420:U19] | UGUGCCAGUCCAGCAU AUGCUGGACUGCUGGCACAUU | 4117 |
| 3646 | AAUGUGAAUGCAGACCAAAGAAA UCAUGCUGGACUGCUGGCACAGA | 2681 | 34703 | V/F bf-3b siNA stab00 [VEGF1438:L19 (1420 C.) + FLT1:3646U21] | UCUUUGGUCUGCAUUCACA AUGCUGGACUGCUGGCACAUU | 4118 |
| 3648 | AAUGUGAAUGCAGACCAAAGAAA UCAUGCUGGACUGCUGGCACAGA | 2681 | 34704 | V/F bf-4a siNA stab00 [FLT1:3664L17 (3648 C.) + VEGF1422:U19] | UGUGCCAGUCCAGC UGAAUGCAGACCAAAGAUU | 4119 |
| 3648 | AAUGUGAAUGCAGACCAAAGAAA UCAUGCUGGACUGCUGGCACAGA | 2681 | 34705 | V/F bf-4b siNA stab00 [VEGF1438:L17 (1422 C.) + FLT1:3648U19] | UCUUUGGUCUGCAUUCA GCUGGACUGCUGGCACAUU | 4120 |
| 3646 | AAUGUGAAUGCAGACCAAAGAAA UCAUGCUGGACUGCUGGCACAGA | 2681 | 34706 | V/F bf-5a siNA stab00 [FLT1:3664L19 (3646 C.) + VEGF1423:U19] | UGUGCCAGUCCAGCAU GAAUGCAGACCAAAGAAAGUU | 4121 |
| 3646 | AAUGUGAAUGCAGACCAAAGAAA UCAUGCUGGACUGCUGGCACAGA | 2681 | 34707 | V/F bf-5b siNA stab00 [VEGF1441:L19 (1420 C.) + FLT1:3646U21] | CUUUCUUUGGUCUGCAUUC AUGCUGGACUGCUGGCACAUU | 4122 |
| 3646 | AUGUGAAUGCAGACCAAAGAAAG UCAUGCUGGACUGCUGGCACAGA | 2682 | 34708 | V/F bf-6a siNA stab00 [FLT1:3664L19 (3646 C.) + VEGF1421:U21] | UGUGCCAGUCCAGCAU GUGAAUGCAGACCAAAGAAUU | 4123 |
| 3646 | AUGUGAAUGCAGACCAAAGAAAG UCAUGCUGGACUGCUGGCACAGA | 2682 | 34709 | V/F bf-6b siNA stab00 [VEGF1439:LI 9(1421 C.) + FLT1:3646U21] | UUCUUUGGUCUGCAUUCAC AUGCUGGACUGCUGGCACAUU | 4124 |
| 1215 | GUGGACAUCUUCCAGGAGUACCC CUGAACUGAGUUUAAAAGGCACC | 2683 | 36408 | V/F bf-L-03 siNA stab00 [VEGF:1215U21 o18S FLT1:346U21] | GGACAUCUUCCAGGAGUACUU L GAACUGAGUUUAAAAGGCAUU | 4125 |
| 1421 | AAUGUGAAUGCAGACCAAAGAAA CUGAACUGAGUUUAAAAGGCACC | 2684 | 36409 | V/F bf-L-02 siNA stab00 [VEGF:1421U21 o18S FLT1:346U21] | GUGAAUGCAGACCAAAGAUU L GAACUGAGUUUAAAAGGCAUU | 4126 |
| 3854 | UUUGAGCAUGGAAGAGGAUUCUG CUGAACUGAGUUUAAAAGGCACC | 2685 | 36411 | F/K bf-L-04 siNA stab00 [KDR:3854U21 o18S FLT1:346U21] | UGAGCAUGGAAGAGGAUCUU L GAACUGAGUUUAAAAGGCAUU | 4127 |
| 346 | CUGAACUGAGUUUAAAAGGCACC AUGUGAAUGCAGACCAAAGAAAG | 2686 | 36416 | V/F bf-L-01 siNA stab00 [FLT1:346U21 o18S VEGF:1421U21] | GAACUGAGUUUAAAAGGCAUU L GUGAAUGCAGACCAAAGAAUU | 4128 |
| 3646 | UCAUGCUGGACUGCUGGCACAGA AUGUGAAUGCAGACCAAAGAAAG | 2687 | 36425 | V/F bf-L-05 siNA stab00 [FLT1:3646U21 o18S VEGF:1421U21] | AUGCUGGACUGCUGGCACAUU L GUGAAUGCAGACCAAAGAAUU | 4129 |
| 3646 | UCAUGGUGGACUGCUGGCACAGA AUGUGAAUGCAGACCAAAGAAAG | 2687 | 36426 | V/F bf-L-06 siNA stab00 c12S [FLT1:3646U21 VEGF:1421U21] | AUGCUGGACUGCUGGCACAUU W GUGAAUGCAGACCAAAGAAUU | |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 3646 | UCAUGCUGGACUGCUGGCACAGA AUGUGAAUGCAGACCAAAGAAAG | 2687 | 36427 | V/F bf-L-07 siNA stab00 [FLT1:3646U21 o95 VEGF:1421U21] | AUGCUGGACUGCUGGCACAUU Y GUGAAUGCAGACCAAAGAAUU | 4130 |
| 3646 | UCAUGCUGGACUGCUGGCACAGA AUGUGAAUGCAGACCAAAGAAAG | 2687 | 36428 | V/F bf-L-08 siNA stab00 [FLT1:3646U21 c35 VEGF:1421U21] | AUGCUGGACUGCUGGCACAUU Z GUGAAUGCAGACCAAAGAAUU | 4131 |
| 3646 | UCAUGCUGGACUGCUGGCACAGA AUGUGAAUGCAGACCAAAGAAAG | 2687 | 36429 | V/F bf-L-09 siNA stab00 [FLT1:3646U21 2x o18S VEGF:1421U21] | AUGCUGGACUGCUGGCACAUU LL GUGAAUGCAGACCAAAGAAUU | 4132 |
| 162 | UCCCUCUCUUUUUCUUAAACA AGAAGAGGAAGCUCCUGAAG | 2688 | 37537 | V/K bf-1a siNA stab00 [VEGF:180L21 (162 C.) -9 + KDR:3263U21] | UUUAAGAAAAAGAGGAAGCUCCUGAUU | 4133 |
| 164 | CCUCUCUUUUUCUUAAACAUU UCAAGAAGAAGGAAACAGAAUC | 2689 | 37538 | V/F bf-7a siNA stab00 [VEGF:182L21 (164 C.) -8 + FLT1:594U21] | UGUUUAAGAAAAAGAAGAAGGAAACAGAAUU | 4134 |
| 202 | AUGUUUCUCGUUUUAAUUAUU AGCGAGAAACAUUCUUUUAUCUG | 2690 | 37539 | V/F bf-8a siNA stab00 [VEGF:220L21 (202 C.) -9 + FLT1:3323U21] | UAAAUUAAAACGAAACAUUCUUUUAUCUU | 4135 |
| 237 | UCCCCACUUGAAUCGGGCCGACG GAUCAAGUGGGCCUUGGAUCGCU | 2691 | 37540 | V/F bf-9a siNA stab00 [VEGF:255L21 (237 C.) -9 + FLT1:5707U21] | UCGGCCCGAUUCAAGUGGCCUUGGAUCGUU | 4136 |
| 238 | CCCCACUUGAAUCGGGCCGACG UUUUCAAGUGGCCAGAGGCAUGG | 2692 | 37541 | V/F bf-10a siNA stab00 [VEGF:256L21 (238 C.) -9 + FLT1:3260U21] | GUCGGCCCGAUUCAAGUGGCCAGAGGCAUUU | 4137 |
| 338 | CUCCAGAGAGAAGUCGAGGAAGA GGUCUCUCUGGUUGUGUAUGUCC | 2693 | 37542 | V/K bf-2a siNA stab00 [VEGF:356L21 (338 C.) -9 + KDR:1541U21] | UUCCUCGACACUUCUCUCUGGUUGUGUAUGUU | 4138 |
| 360 | AGAGAGACGGGUCAGAGAGAGC AGACCCGUCCUAUACCAACCA | 2694 | 37543 | V/F bf-11 a siNA stab00 [VEGF:378L21 (360 C.) -11 + FLT1:5354U21] | UCUCUCUGACCCGUCCUAUACCAACUU | 4139 |
| 484 | GCAGCUGACCAGUCGCGCUGACG CAUGGUCAGCUACUGGGACACCG | 2695 | 37544 | V/F bf-12a siNA stab00 [VEGF:502L21 (484 C.) -9 + FLT1:251U21] | UCAGCGCGACUGGUCAGCUACUGGGACACUU | 4140 |
| 654 | CUGAAAACUUUCGUCCAACUCU AAAAAAGUUCCACUUGACACUU | 2696 | 37545 | V/F bf-13a siNA stab00 [VEGF:672L21 (654 C.) -9 + FLT1:758U21] | AAGUGGACGAAAAGUUCCACUUGACACUU | 4141 |
| 978 | CCCCACAGCCUCGAGCCGAGAGG UGCUGUGGGAAAUCUUCCCUU | 2697 | 37546 | V/F bf-14a siNA stab00 [VEGF:996L21 (978 C.) -7 + FLT1:3513U21] | UCUCCGGCUCGGGCUCGUGUGGGAAAUCUUCCCUU | 4142 |
| 1038 | ACCAUGAACUUUCUGCUGUCUUG UCAAGUUCAUGAGCCUGGAAAGA | 2698 | 37547 | V/F bf-15a siNA stab00 [VEGF:1056L21 (1038 C.) -9 + FLT1:3901U21] | AGACAGCAGAAAGUUCAUGAGCCUGGAAUU | 4143 |
| 1095 | CACCAUGCCAAGUGGUCCCAGGC AGGGCAUGGAGUUCUUGGCAUCG | 2699 | 37548 | V/K bf-3a siNA stab00 [VEGF:1113L21 (1095 C.) -7 + KDR:3346U21] | CUGGGACCACUUGGCAUGGAGUUCUUGGCAUUU | 4144 |
| 1253 | CAUCUUCAAGCCAUCCUGUGUGC UGUUGAAGAAGUUCUACCUAAAC | 2700 | 37549 | V/K bf-4a siNA stab00 [VEGF:1271L21 (1253 C.) -7 + | ACACAGGAUGGCUUGAAGAUGGGAAGAGGAUUUU | 4145 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1351 | UGCAGAUUAUGCCGAUCAAACCU AACGCAUAAUCUGGGACAGUAGA | 2701 | 37550 | KDR:4769U21] V/F bf-16a siNA stab00 [VEGF:1369L21 (1351 C.) -11 + FLT1:796U21] | GUUUGAUCCCAUAAUCUGGGACAGUAUU | 4146 |
| 1352 | GCAGAUUAUGCCGAUCAAACCUC AACCAUAAUCUGGGACAGUAGA | 2702 | 37551 | V/F bf-17a siNA stab00 [VEGF:1370L21 (1352 C.) -10 + FLT1:796U21] | GGUUUGAUCCGCAUAAUCUGGGACAGUAUU | 4147 |
| 1389 | AUAGGAGAAGAGCUUCCUACA UAAUCUCCUGUGGAUCCCUAC | 2703 | 37552 | V/K bf-5a siNA stab00 [VEGF:1407L21 (1389 C.) -9 + KDR:1588U21] | UAGGAAGCUCAUCUCCUGUGGAUUCCUUU | 4148 |
| 1401 | AGCUUCCUACAGCACAACAAAUG UCAGGAAGCUCUGAUGAGUCAG | 2704 | 37553 | V/F bf-18a siNA stab00 [VEGF:1419L21 (1401 C.) -6 + FLT1:3864U21] | UUUGUUGUGCUGUAGGAAGCUCUGAUGAUGUCUU | 4149 |
| 1408 | UACAGCACACAAAAUGUAAUGC UCGUGUGCUGUUUCUGACUCCU | 2705 | 37554 | V/K bf-6a siNA stab00 [VEGF:1426L21 (1408 C.) -9 + KDR:5038U21] | AUUCACAUUUGUCUGUUUCUGACUCUU | 4150 |
| 1417 | ACAAAUGUAAUGCAGACCAAAG CUAUUCACAUUUGUCUGACAGUAU | 2706 | 37555 | V/K bf-7a siNA stab00 [VEGF:1435L21 (1417 C.) -10 + KDR:5737U21] | AUGGCUCUGCAUUCACAUUUUGUAUCAGUUU | 4151 |
| 162 | UCCCUCUCUUUUUCUUAAACA AGAAGAAGGAAGCUCCUGAAG | 2688 | 37556 | V/K bf-1b siNA stab00 [KDR:3281L21 (3263 C.) -9 + VEGF:162U21] | UCAGGAGCUUCCUUCCUGUUUUUCUUUAAAUU | 4152 |
| 164 | CCUCUCUUUUUCUUAAACAUU UCAAAGAAGAAGCAAAGAAUC | 2689 | 37557 | V/F bf-7b siNA stab00 [FLT1:612L21 (594 C.) -8 + VEGF:164U21] | UUCUGUUUCCUUCUUUUUUCUUAAACAUU | 4153 |
| 202 | AUUGUUUCUGUUUAAUUAUU AGCCAGAGAAACAUUCUUUAUCUG | 2690 | 37558 | V/F bf-8b siNA stab00 [FLT1:3341L21 (3323 C.) -9 + VEGF:202U21] | GAUAAAGAAUGAUGCUCGUUUUAUUUAUU | 4154 |
| 237 | UCCCCACUUGAAUCGGGCCACG GAUCAAGUGGGCCUUGGAUCGCU | 2691 | 37559 | V/F bf-9b siNA stab00 [FLT1:5725L21 (5707 C.) -9 + VEGF:237U21] | CGAUCCAAGGCCCACUUGAAUCGGGCCGAUU | 4155 |
| 238 | CCCCACUUGAAUCGGGCCGACGG UUUUCAAGUGGCCAGAGGCAUGG | 2692 | 37560 | V/F bf-10b siNA stab00 [FLT1:3278L21 (3260 C.) -9 + VEGF:238U21] | AUGCCUCUGGCCACUUGAAUCGGCCGACUU | 4156 |
| 338 | CUCCAGAGAAGAAGUCGAGAAGA GGUCUCUCUGGUUGUGUAUGCC | 2693 | 37561 | V/K bf-2b siNA stab00 [KDR:1559L21 (1541 C.) -9 + VEGF:338U21] | ACAUACACAACCAGAGAAGUCGAGGAAUU | 4157 |
| 360 | AGAGAGACGGGGUCAGAGAGC AGACCCCGUCUCUAUACCAACCA | 2694 | 37562 | V/F bf-11b siNA stab00 [FLT1:5372L21 (5354 C.) -11 + VEGF:360U21] | GUUGGUAUAGAGACGCGGGUCAGAGAGAUU | 4158 |
| 484 | GCAGCUGACCAGUCGCGCUGACG CAUGGUCAGCUACUGGGACACCG | 2695 | 37563 | V/F bf-12b siNA stab00 [FLT1:269L21 (251 C.) -9 + VEGF:484U21] | GUGUCCCAGUAGCUGACCAGUCGCGCUGAUU | 4159 |
| 654 | CUGAAACAUUUUCGUCCAACUUCU AAAAAAGUUCCACUUGACACUU | 2696 | 37564 | V/F bf-13b siNA stab00 [FLT1:776L21 (758 C.) -9 + VEGF:654U21] | GUGUCAAGUGGAAACUUUUCGUCCAACUUU | 4160 |
| 978 | CCCACAGCCCGAGCCGAGAGG | 2697 | 37565 | V/F bf-14b siNA stab00 | GGAGAAGAUUUCCCACAGCCCGAGCCGAGAUU | 4161 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| | UUGCUGUGGAAAUCUUCUCCUU | | | [FLT1:3531L21 (3513 C.) -7 + VEGF:978U21] | UUUCCAGGCUCAUGAACUUUCUGCUGUCUUTT | 4162 |
| 1038 | ACCAUGAACUUUCUGCUGCUUG UCAAGUUCAUGAGCCUGGAAAGA | 2698 | 37566 | V/F bf-15b siNA stab00 [FLT1:3919L21 (3901 C.) -9 + VEGF:1038U21] | AUGCCAAGAACUCCAUGCCAAGUGGUCCCAGTT | 4163 |
| 1095 | CACCAUGCCAAGUGGUCCCAGGC AGGGCAUGGAGUUCUUGGCAUCG | 2699 | 37567 | V/K bf-3b siNA stab00 [KDR:3364L21 (3346 C.) -7 + VEGF:1095U21] | AAAUCCUUCCCAUCUUCAAGCCAUCCUGUUTT | 4164 |
| 1253 | CAUCUUCAAGCCAUCCUGUGUGC UGUUGAAGAUGGAAGGAUUUGC | 2700 | 37568 | V/K bf-4b siNA stab00 [KDR:4787L21 (4769 C.) -7 + VEGF:1253U21] | UACUGUCCCAGAUUAUGCGGAUCAAACTT | 4165 |
| 1351 | UGCAGAUUAUGCGGAUCAAACCU AACGCAUAAUCUGGGACAGUAGA | 2701 | 37569 | V/F bf-16b siNA stab00 [FLT1:814L21 (796 C.) -11 + VEGF:1351U21] | UACUGUCCCAGAUUAUGCGGAUCAAACCTT | 4166 |
| 1352 | GCAGAUUAUGCGGAUCAAACCUC AACGCAUAAUCUGGGACAGUAGA | 2702 | 37570 | V/F bf-17b siNA stab00 [FLT1:814L21 (796 C.) -10 + VEGF:1352U21] | AGGAAUCCACAGGAGAGAUGAGCUUCCUATT | 4167 |
| 1389 | AUAGGAGAGAUGAGCUUCCUACA UAAUCUCCUGUGGAUUCCUAC | 2703 | 37571 | V/K bf-5b siNA stab00 [KDR:1606L21 (1588 C.) -9 + VEGF:1389U21] | GACAUCAGAGCUUCCUACAGCACAACAAATT | 4168 |
| 1401 | AGCUUCCUACAGCACAACAAAUG UCGAAGGAUGUCGUUGUUUACAG | 2704 | 37572 | V/F bf-18b siNA stab00 [FLT1:3882L21 (3864 C.) -6 + VEGF:1401U21] | GAGUCAGAAACAGCACACAAAUGUGAAUTT | 4169 |
| 1408 | UACAGCACACAAAUGUGAAUGC UCGUGUGCUUGACACUUACUCCU | 2705 | 37573 | V/K bf-6b siNA stab00 [KDR:5056L21 (5038 C.) -9 + VEGF:1408U21] | ACUGAUACAAAAUGUGAAUGCAGACCAATT | 4170 |
| 1417 | ACAAAUGUGAAUGCAGACCAAAG CUAUUCACAUUUGUACAGUAU | 2706 | 37574 | V/K bf-7b siNA stab00 [KDR:5755L21 (5737 C.) -10 + VEGF:1417U21] | UGUGccAGcAGucCAGcAu AGcAuuuGuuuGuAcAAGATT B | 4171 |
| 3646 | AAAGCAUUUGUUUGUACAAGAUC UCAUGCUGGACUCUGCUGGCACAGA | 2676 | 37578 | V/F bf-1a siNA stab07/26 [FLT1:3664L19 (3646 C.) -5 + VEGF:1562U21] | UCUuGuAcAAAcAAAuGcu AuGcuGGAcUcuGGcAcATT B | 4172 |
| 3646 | AAAGCAUUUGUUUGUACAAGAUC UCAUGCUGGACUCUGCUGGCACAGA | 2676 | 37579 | V/F bf-1b siNA stab07/26 [VEGF:1580L19 (1562 C.) -5 + FLT1:3646U21] | B GGAAuCuuccAGGAGuAcTT L GAAcuGAGuuuAAAAGGcATT B | 4173 |
| 1215 | GUGGACAUCUUCCAGGAGUACCC CGAACUGAGUUUAAAAGGCACC | 2683 | 37777 | V/F bf-L-03 siNA stab07 [VEGF:1215U21 o18S FLT1:346U21] | B GuGAAuGcAGAccAAAGAATT L GAAcuGAGuuuAAAAGGcATT B | 4174 |
| 1421 | AUGUGAAUGCAGACCAAAGAAAG CUGAACUGAGUUUAAAAGGCACC | 2684 | 37778 | V/F bf-L-02 siNA stab07 [VEGF:1421U21 o18S FLT1:346U21] | B GAAcuGAGuuuAAAAGGcATT L GuGAAuGcAGAccAAAGAATT B | 4175 |
| 1421 | CUGAACUGAGUUUAAAAGGCACC AUGUGAAUGCAGACCAAAGAAAG | 2686 | 37779 | V/F bf-L-01 siNA stab07 [FLT1:346U21 o18S VEGF:1421U21] | B AuGcuGGAcuGcuGGcAcATT L GuGAAuGcAGAccAAAGAATT B | 4176 |
| 1421 | UCAUGCUGGACUGCUGGCACAGA AUGUGAAUGCAGACCAAAGAAAG | 2687 | 37780 | V/F bf-L-05 siNA stab07 [FLT1:3646U21 o18S VEGF:1421U21] | | |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 1421 | UCAUGCUGGACUGCUGGCACAGA AUGUGAAUGCAGACCAAAGAAAG | 2687 | 37783 | V/F bf-L-05 siNA stab00 10 nt [FLT1:3646U21 VEGF:1421U21] | AUGCUGGACUGCUGGCACAUU GUGAAUGCAGACCAAAGAAUU GAUCAUCGUA | 4177 |
| 1421 | UCAUGCUGGACUGCUGGCACAGA AUGUGAAUGCAGACCAAAGAAAG | 2687 | 37784 | V/F bf-L-05 siNA stab00 6 nt [FLT1:3646U21 VEGF:1421U21] | AUGCUGGACUGCUGGCACAUU GUGAAUGCAGACCAAAGAAUU GAUCAU | 4178 |
| 1421 | UCAUGCUGGACUGCUGGCACAGA AUGUGAAUGCAGACCAAAGAAAG | 2687 | 37785 | V/F bf-L-05 siNA stab00 3 nt [FLT1:3646U21 VEGF:1421U21] | AUGCUGGACUGCUGGCACAUU GUGAAUGCAGACCAAAGAAUU GAU | 4179 |
| 1421 | UCAUGCUGGACUGCUGGCACAGA AUGUGAAUGCAGACCAAAGAAAG | 2687 | 37786 | V/F bf-L-05 siNA stab00 no linker [FLT1:3646U21 VEGF:1421U21] | AUGCUGGACUGCUGGCACAUU GUGAAUGCAGACCAAAGAAUU | 4180 |
| 1421 | AUGUGAAUGCAGACUGCUGGCACAGA UCAUGCUGGACUGCUGGCACAGA | 2682 | 37787 | V/F bf-6a siNA stab07/26 [FLT1:3664L19 (3646 C.) + VEGF1421:U21] | UGUGccAGcAGucCAGcAuUU GuGAAuGcAGAccAGAAGAAUU B | 4181 |
| 1421 | AUGUGAAUGCAGACUGCUGGCACAGA UCAUGCUGGACUGCUGGCACAGA | 2682 | 37788 | V/F bf-6b siNA stab07/26 [VEGF1439:L19 (1421 C.) + FLT1:3646U21] | UUCuuuGGucuGAuucAcUU AuGcuGGAcuGcuGGcACAUU B | 4182 |
| 346 | CUGAACUGAGUUUAAAAGGCACC AUGUGAAUGCAGACCAAAGAAAG | 2686 | 38287 | V/F bf-L-10a siNA stab09 [FLT1:346U21 o18S VEGF:1421U21] | B GAACUGAGUUUAAAAGGCAUU L GUGAAUGCAGACCAAAGAAUU B | 4183 |
| 346 | CUGAACUGAGUUUAAAAGGCACC AUGUGAAUGCAGACCAAAGAAAG | 2686 | 38288 | V/F bf-L-11a siNA stab09 [FLT1:346U21 + VEGF:1421U21] | B GAACUGAGUUUAAAAGGCA GUGAAUGCAGACCAAAGAA B | 4184 |
| 346 | CUGAACUGAGUUUAAAAGGCACC AUGUGAAUGCAGACCAAAGAAAG | 2686 | 38289 | V/F bf-L-11b siNA stab00 [VEGF:1439L21 (1421 C.) + FLT1:364L21 (346 C.)] | UUCUUUGGUCUGCAUUCAC UGCCUUUUAAACUCAGUUC | 4185 |
| 346 | CUGAACUGAGUUUAAAAGGCACC AUGUGAAUGCAGACCAAAGAAAG | 2686 | 38369 | V/F bf-L-26a siNA stab22 [FLT1:364L21 siNA (346 C.) + VEGF:1421U21] | UGCCUUUUAAACUCAGUUC GUGAAUGCAGACCAAAGAAUU B | 4186 |
| 346 | CUGAACUGAGUUUAAAAGGCACC AUGUGAAUGCAGACCAAAGAAAG | 2686 | 38370 | V/F bf-26b siNA stab22 [VEGF:1439U21 siNA (1421 C.) + FLT1:346U21 siNA] | UUCUUUGGUCUGCAUUCAC GAACUGAGUUUAAAAGGCAUU B | 4187 |

VEGF/VEGFR DFO siNA

| Target Pos | Target | Seq ID | Cmpd # | Aliases | Sequence | Seq ID |
|---|---|---|---|---|---|---|
| 349 | AACUGAGUUUAAAAGGCACCCAG | 2289 | 32718 | FLT1:367L2i siRNA (349 C.) v1 5'p palindrome | pGGUGCCUUUUAAACUC GAGUUUAAAAG B | 2810 |
| 349 | AACUGAGUUUAAAAGGCACCCAG | 2289 | 32719 | FLT1:367L21 siRNA (349 C.) v2 5'p palindrome | pGGGUGCCUUUUAAACUCAG GAGUUUAAAAG B | 2811 |
| 2949 | AAGCAAGGAGGGCCUCUCGAUGGU | 2290 | 32720 | FLT1:2967L21 siRNA (2949 C.) v1 5'p palindrome | pCAUCGAGAGGCCCUCCUUGC AAGAGGGCCUCUU B | 2812 |
| 2949 | AAGCAAGGAGGGCCUCUCGAUGGU | 2290 | 32721 | FLT1:2967L21 siRNA (2949 C.) v2 5'p palindrome | pCAUCAGAGAGGCCCUCCUU AAGAGGGCCUCUG B | 2813 |
| 2949 | AAGCAAGGAGGGCCUCUCGAUGGU | 2290 | 32722 | FLT1:2967L21 siRNA (2949 C.) v3 5'p palindrome | pCAUCAGAGCCCUCCCCU AGGAGGGCCUCUG B | 2814 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 354 | AGUUUAAAAGGCACCCAGCACAUC | 2707 | 32805 | FLT1:372L21 siRNA (354 C.) v1 5'p palindrome | pGUGCUGGGUGCCUUUUAAA AGGCACCCAGC B | 4188 |
| 354 | AGUUUAAAAGGCACCCAGCACAUC | 2707 | 32806 | FLT1:372L21 siRNA (354 C.) v2 5'p palindrome | pGUGCUGGGUGCCUUUUAAA GGCACCCAGC B | 4189 |
| 354 | AGUUUAAAAGGCACCCAGCACAUC | 2707 | 32807 | FLT1:372L21 siRNA (354 C.) v3 5'p palindrome | pGUGCUGGGUGCCUUAAGGCACCCAGC B | 4190 |
| 1229 | GCAUAUAUAUGAUAAAGCAUUCA | 2708 | 32808 | FLT1:1247L21 siRNA (1229 C.) v1 5'p palindrome | pAAUGCUUUAUCAUAUAUAU GAUAAAGC B | 4191 |
| 1229 | GCAUAUAUAUGAUAAAGCAUUCA | 2708 | 32809 | FLT1:1247L21 siRNA (1229 C.) v2 5'p palindrome | pAAUGCUUUAUCAUAUAU GAUAAAGC B | 4192 |
| 1229 | GCAUAUAUAUGAUAAAGCAUUCA | 2708 | 32810 | FLT1:1247L21 siRNA (1229 C.) v3 5'p palindrome | pAAUGCUUUAUCAUAU GAUAAAGC B | 4193 |
| 1229 | GCAUAUAUAUGAUAAAGCAUUCA | 2708 | 32811 | FLT1:1247L21 siRNA (1229 C.) v4 5'p palindrome | pAAUGCUUUAUCAUAU GAUAAAGCA B 4194 | 4195 |
| 1229 | GCAUAUAUAUGAUAAAGCAUUCA | 2708 | 32812 | FLT1:1247L21 siRNA (1229 C.) v5 5'p palindrome | pAAUGCUUUAUCAUAUAU GAUAAAGCAUU B | |
| 1229 | GCAUAUAUAUGAUAAAGCAUUCA | 2708 | 32813 | FLT1:1247L21 siRNA (1229 C.) v6 5'p palindrome | pAAUGCUUUAUCAUAUAU GAUAAGCAUU B4196 | |
| 349 | AACUGAGUUUAAAAGGCACCCAG | 2289 | 33056 | FLT1:367L21 siRNA (349 C.) v3 5'p palindrome | pGGGUGCCUUUUAAACUCAG GAGUUAAAAGG B | 4197 |
| 349 | AACUGAGUUUAAAAGGCACCCAG | 2289 | 33057 | FLT1:367L21 siRNA (349 C.) v4 5'p palindrome | pGGGUGCCUUUUAAACUC GAGUUAAAAGGCA B | 4198 |
| 349 | AACUGAGUUUAAAAGGCACCCAG | 2289 | 33058 | FLT1:367L21 siRNA (349 C.) v5 5'p palindrome | pGGGUGCCUUUUAAACU AGUUUAAAAGG B | 4199 |
| 349 | AACUGAGUUUAAAAGGCACCCAG | 2289 | 33059 | FLT1:367L21 siRNA (349 C.) v6 5'p palindrome | pGGGUGCCUUUUAAACU AGUUUAAAAGGC B | 4200 |
| 349 | AACUGAGUUUAAAAGGCACCCAG | 2289 | 33060 | FLT1:367L21 siRNA (349 C.) v7 5'p palindrome | pGGGUGCCUUUUAAACU AGUUUAAAAGGCA B | 4201 |
| 349 | AACUGAGUUUAAAAGGCACCCAG | 2289 | 33061 | FLT1:367L21 siRNA (349 C.) v8 5'p palindrome | pGGGUGCCUUUUAAACU AGUUUAAAAGGCAC B | 4202 |
| 349 | AACUGAGUUUAAAAGGCACCCAG | 2289 | 33062 | FLT1:367L21 siRNA (349 C.) v9 5'p palindrome | pGGGUGCCUUUUAAAC GUUUAAAAGGC B | 4203 |
| 349 | AACUGAGUUUAAAAGGCACCCAG | 2289 | 33063 | FLT1:367L21 siRNA (349 C.) v10 5'p palindrome | pGGGUGCCUUUUAAAC GUUUAAAAGGCA B | 4204 |
| 349 | AACUGAGUUUAAAAGGCACCCAG | 2289 | 33064 | FLT1:367L21 siRNA (349 C.) v11 5'p palindrome | pGGGUGCCUUUUAAAC GUUUAAAAGGCAC B | 4205 |
| 354 | AGUUUAAAAGGCACCCAGCACAU | 2316 | 34092 | FLT1:371L18 siRNA (354 C.) v4 5'p palindrome | pUGCUGGGUGCCUUUUAAA AGGCACCCAGC B | 4206 |
| 354 | AGUUUAAAAGGCACCCAGCACAU | 2316 | 34093 | FLT1:370L17 siRNA (354 C.) v5 5'p palindrome | pGCUGGGUGCCUUUUAAA AGGCACCCAGC B | 4207 |
| 354 | AGUUUAAAAGGCACCCAGCACAU | 2316 | 34094 | FLT1:370L17 siRNA (354 C.) v6 5'p palindrome | pGCUGGGUGCCUUUUAAA AGGCACCCAGCU B | 4208 |
| 354 | AGUUUAAAAGGCACCCAGCACAU | 2316 | 34095 | FLT1:370L17 siRNA (354 C.) v7 5'p palindrome | pGCUGGGUGCCUUUUAAA AGGCACCCAG B | 4209 |
| 354 | AGUUUAAAAGGCACCCAGCACAU | 2316 | 34096 | FLT1:369L16 siRNA (354 C.) v8 5'p palindrome | pCUGGGUGCCUUUUAAA AGGCACCCAG B | 4210 |
| 354 | AGUUUAAAAGGCACCCAGCACAU | 2316 | 34097 | FLT1:369L16 siRNA (354 C.) v9 5'p palindrome | pCUGGGUGCCUUUUAAAGGCACCCA B | 4211 |

TABLE III-continued

VEGF and/or VEGFR Synthetic Modified siNA Constructs

| Target Pos | Target | Seq ID | Cmpd # | Aliases | Sequence | Seq ID |
|---|---|---|---|---|---|---|
| 354 | AGUUUAAAAGGCACCCAGCACAU | 2316 | 34098 | FLT1:368L15 siRNA (354 C.) v10 5'p palindrome | pUGGGUGCCUUUUAAA AGGCACCCA B | 4212 |
| 354 | AGUUUAAAAGGCACCCAGCACAU | 2316 | 34099 | FLT1:368L15 siRNA (354 C.) v11 5'p palindrome | pUGGGUGCCUUUUAAAAGGCACCCAT B | 4213 |
| 354 | AGUUUAAAAGGCACCCAGCACAU | 2316 | 34100 | FLT1:368L15 siRNA (354 C.) v12 5'p palindrome | pUGGGUGCCUUUUAAA AGGCACCCATT B | 4214 |
| 1229 | GCAUAUAUAUGAUAAAGCAUUCA | 2708 | 34101 | FLT1:1247L21 siRNA (1229 C.) v14 5'p palindrome | pUGCUUUAUCAUAUAU GAUAAAGCA B | 4215 |
| 1229 | GCAUAUAUAUGAUAAAGCAUUCA | 2708 | 34102 | FLT1:1247L21 siRNA (1229 C.) v15 5'p palindrome | pUGCUUUAUCAUAUAU GAUAAAGC B | 4216 |
| 1229 | GCAUAUAUAUGAUAAAGCAUUCA | 2708 | 34103 | FLT1:1247L21 siRNA (1229 C.) v16 5'p palindrome | pGCUUUAUCAUAUAU GAUAAAG B | 4217 |
| 1229 | GCAUAUAUAUGAUAAAGCAUUCA | 2708 | 34104 | FLT1:1247L17 siRNA (1229 C.) v5 palindrome | AAUGCUUUAUCAUAUAU GAUAAAGCAUU B | 4218 |
| 1229 | GCAUAUAUAUGAUAAAGCAUUCA | 2708 | 34105 | FLT1:1247L17 siRNA (1229 C.) v7 5'p palindrome | pAAUGCUUUAUCAUAUAU GAUAAAGCAUUT B | 4219 |
| 1229 | GCAUAUAUAUGAUAAAGCAUUCA | 2708 | 34106 | FLT1:1247L17 siRNA (1229 C.) v8 5'p palindrome | pAAUGCU UUAUCAUAUAU GAUAAAGCAUUTT B | 4220 |
| 1229 | GCAUAUAUAUGAUAAAGCAUUCA | 2708 | 34107 | FLT1:1247L17 siRNA (1229 C.) v9 5'p palindrome | pAAUGCUUUAUCAUAUAU GAUAAAGCAUT B | 4221 |
| 1229 | GCAUAUAUAUGAUAAAGCAUUCA | 2708 | 34108 | FLT1:1247L16 siRNA (1229 C.) v10 | pAUGCUUUAUCAUAUAU GAUAAAGCATT B | 4222 |
| 1229 | GCAUAUAUAUGAUAAAGCAUUCA | 2708 | 34109 | FLT1:1247L16 siRNA (1229 C.) v11 5'p palindrome | pAUGCUUUAUCAUAUAU GAUAAAGCAUT B | 4223 |
| 1229 | GCAUAUAUAUGAUAAAGCAUUCA | 2708 | 34110 | FLT1:1247L16 siRNA (1229 C.) v12 5'p palindrome | pAUGCUUUAUCAUAUAU GAUAAAGCAUTT B | 4224 |
| 1229 | GCAUAUAUAUGAUAAAGCAUUCA | 2708 | 34111 | FLT1:1247L16 siRNA (1229 C.) v13 5'p palindrome | pAUGCUUUAUCAUAUAU GAUAAAGCA B | 4225 |
| 1229 | GCAUAUAUAUGAUAAAGCAUUCA | 2708 | 34112 | FLT1:1247L17 siRNA (1229 C.) v14 5'p palindrome | pAAUGCUUUAUCAUAUAU CUAUAAGCAUTT B | 4226 |
| 1229 | GCAUAUAUAUGAUAAAGCAUUCA | 2708 | 34113 | FLT1:1247L17 siRNA (1229 C.) v15 5'p palindrome | pAAUGCUUUUAGUUAUAU GAUAAAGCAUTT B | 4227 |
| 1229 | GCAUAUAUAUGAUAAAGCAUUCA | 2708 | 34114 | FLT1:1247L17 siRNA (1229 C.) v16 5'p palindrome | pAAUCCUUUAAUCUAUUU GAUAAAGCAUT B | 4228 |
| 1229 | GCAUAUAUAUGAUAAAGCAUUCA | 2708 | 34115 | FLT1:1247L17 siRNA (1229 C.) v17 5'p palindrome | pAAuGCuuuAucAuAuAu GAuAAAGCAuu B | 4229 |
| 1229 | GCAUAUAUAUGAUAAAGCAUUCA | 2708 | 34116 | FLT1:1247L17 siRNA (1229 C.) v18 5'p palindrome | pAAuGcuuuAucAuAuAu GAuAAAGcAuu B | 4230 |

Uppercase = ribonucleotide
u, c = 2'-deoxy-2'-fluoro U, C
T = thymidine
B = inverted deoxy abasic
s = phosphorothioate linkage
A = deoxy Adenosine
G = deoxy Guanosine TABLE III-continued VEGF and/or VEGFR Synthetic Modified siNA Constructs

| Target Pos | Target | Seq ID | Cmpd # | Aliases | Sequence | Seq ID |
|---|---|---|---|---|---|---|

G = 2'-O-methyl Guanosine
A = 2'-O-methyl Adenosine
X = 3'-deoxy T
X = nitroindole
Z = nitropyrrole
T = thymidine
t = L-thymidine
u = L uridine
D = inverted thymidine
L = 5'amino mod-C5 TFA ( from W.W.)
L = hegS = hexethelyne glycol spacer; spacer-18 (Glen Research 10-1918-xx)
M = C12 spacer; spacer C12 (Glen Research 10-1928-xx)
Y = tetraethelyne glycol spacer; spacer 9 (Glen Research 10-1909-xx)
Z = C3 spacer; spacer C3 (Glen Research 10-1913-xx)
p = terminal phosphate
I = rI = ribO inosine (Glen Res #10-3044-xx)
U = 3'-O-Methyl Uridine
Gyl = glyceryl

TABLE IV

Non-limiting examples of Stabilization Chemistries for chemically modified siNA constructs

| Chemistry | pyrimidine | Purine | cap | p = S | Strand |
|---|---|---|---|---|---|
| "Stab 00" | Ribo | Ribo | TT at 3'-ends | — | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | S/AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | — | Usually S |
| "Stab 13" | 2'-fluoro | LNA | — | 1 at 3'-end | Usually AS |
| "Stab 14" | 2'-fluoro | 2'-deoxy | — | 2 at 5'-end 1 at 3'-end | Usually AS |
| "Stab 15" | 2'-deoxy | 2'-deoxy | — | 2 at 5'-end 1 at 3'-end | Usually AS |
| "Stab 16" | Ribo | 2'-O-Methyl | 5' and 3'-ends | — | Usually S |
| "Stab 17" | 2'-O-Methyl | 2'-O-Methyl | 5' and 3'-ends | — | Usually S |
| "Stab 18" | 2'-fluoro | 2'-O-Methyl | 5' and 3'-ends | — | Usually S |
| "Stab 19" | 2'-fluoro | 2'-O-Methyl | 3'-end | — | S/AS |
| "Stab 20" | 2'-fluoro | 2'-deoxy | 3'-end | — | Usually AS |
| "Stab 21" | 2'-fluoro | Ribo | 3'-end | — | Usually AS |
| "Stab 22" | Ribo | Ribo | 3'-end | — | Usually AS |
| "Stab 23" | 2'-fluoro* | 2'-deoxy* | 5' and 3'-ends | — | Usually S |
| "Stab 24" | 2'-fluoro* | 2'-O-Methyl* | — | 1 at 3'-end | S/AS |
| "Stab 25" | 2'-fluoro* | 2'-O-Methyl* | — | 1 at 3'-end | S/AS |
| "Stab 26" | 2'-fluoro* | 2'-O-Methyl* | — | — | S/AS |
| "Stab 27" | 2'-fluoro* | 2'-O-Methyl* | 3'-end | — | S/AS |
| "Stab 28" | 2'-fluoro* | 2'-O-Methyl* | 3'-end | — | S/AS |
| "Stab 29" | 2'-fluoro* | 2'-O-Methyl* | — | 1 at 3'-end | S/AS |
| "Stab 30" | 2'-fluoro* | 2'-O-Methyl* | — | — | S/AS |
| "Stab 31" | 2'-fluoro* | 2'-O-Methyl* | 3'-end | — | S/AS |
| "Stab 32" | 2'-fluoro | 2'-O-Methyl | — | — | S/AS |
| "Stab 33" | 2'-fluoro | 2'-deoxy* | 5' and 3'-ends | — | Usually S |
| "Stab 34" | 2'-fluoro | 2'-O-Methyl* | 5' and 3'-ends | — | Usually S |
| "Stab 3F" | 2'-OCF3 | Ribo | — | 4 at 5'-end 4 at 3'-end | Usually S |
| "Stab 4F" | 2'-OCF3 | Ribo | 5' and 3'-ends | — | Usually S |
| "Stab 5F" | 2'-OCF3 | Ribo | — | 1 at 3'-end | Usually AS |
| "Stab 7F" | 2'-OCF3 | 2'-deoxy | 5' and 3'-ends | — | Usually S |
| "Stab 8F" | 2'-OCF3 | 2'-O-Methyl | — | 1 at 3'-end | S/AS |
| "Stab 11F" | 2'-OCF3 | 2'-deoxy | — | 1 at 3'-end | Usually AS |
| "Stab 12F" | 2'-OCF3 | LNA | 5' and 3'-ends | — | Usually S |
| "Stab 13F" | 2'-OCF3 | LNA | — | 1 at 3'-end | Usually AS |
| "Stab 14F" | 2'-OCF3 | 2'-deoxy | — | 2 at 5'-end 1 at 3'-end | Usually AS |
| "Stab 15F" | 2'-OCF3 | 2'-deoxy | — | 2 at 5'-end 1 at 3'-end | Usually AS |
| "Stab 18F" | 2'-OCF3 | 2'-O-Methyl | 5' and 3'-ends | — | Usually S |
| "Stab 19F" | 2'-OCF3 | 2'-O-Methyl | 3'-end | — | S/AS |
| "Stab 20F" | 2'-OCF3 | 2'-deoxy | 3'-end | — | Usually AS |
| "Stab 21F" | 2'-OCF3 | Ribo | 3'-end | — | Usually AS |
| "Stab 23F" | 2'-OCF3* | 2'-deoxy* | 5' and 3'-ends | — | Usually S |
| "Stab 24F" | 2'-OCF3* | 2'-O-Methyl* | — | 1 at 3'-end | S/AS |
| "Stab 25F" | 2'-OCF3* | 2'-O-Methyl* | — | 1 at 3'-end | S/AS |
| "Stab 26F" | 2'-OCF3* | 2'-O-Methyl* | — | — | S/AS |
| "Stab 27F" | 2'-OCF3* | 2'-O-Methyl* | 3'-end | — | S/AS |
| "Stab 28F" | 2'-OCF3* | 2'-O-Methyl* | 3'-end | — | S/AS |
| "Stab 29F" | 2'-OCF3* | 2'-O-Methyl* | — | 1 at 3'-end | S/AS |
| "Stab 30F" | 2'-OCF3* | 2'-O-Methyl* | — | — | S/AS |
| "Stab 31F" | 2'-OCF3* | 2'-O-Methyl* | 3'-end | — | S/AS |
| "Stab 32F" | 2'-OCF3 | 2'-O-Methyl | — | — | S/AS |
| "Stab 33F" | 2'-OCF3 | 2'-deoxy* | 5' and 3'-ends | — | Usually S |
| "Stab 34F" | 2'-OCF3 | 2'-O-Methyl* | 5' and 3'-ends | — | Usually S |

CAP = any terminal cap, see for example FIG. 10.
All Stab 00-34 chemistries can comprise 3'-terminal thymidine (TT) residues
All Stab 00-34 chemistries typically comprise about 21 nucleotides, but can vary as described herein.
All Stab 00-34 chemistries can also include a single ribonucleotide in the sense or passenger strand at the $11^{th}$ base paired position of the double stranded nucleic acid duplex as determined from the 5'-end of the antisense or guide strand (see FIG. 6C)
S = sense strand
AS = antisense strand
*Stab 23 has a single ribonucleotide adjacent to 3'-CAP
*Stab 24 and Stab 28 have a single ribonucleotide at 5'-terminus
*Stab 25, Stab 26, and Stab 27 have three ribonucleotides at 5'-terminus
*Stab 29, Stab 30, Stab 31, Stab 33, and Stab 34 any purine at first three nucleotide positions from 5'-terminus are ribonucleotides
p = phosphorothioate linkage

TABLE V

| A. 2.5 µmol Synthesis Cycle ABI 394 Instrument | | | | | |
|---|---|---|---|---|---|
| Reagent | Equivalents | Amount | Wait Time* DNA | Wait Time* 2'-O-methyl | Wait Time* RNA |
| Phosphoramidites | 6.5 | 163 µL | 45 sec | 2.5 min | 7.5 min |
| S-Ethyl Tetrazole | 23.8 | 238 µL | 45 sec | 2.5 min | 7.5 min |
| Acetic Anhydride | 100 | 233 µL | 5 sec | 5 sec | 5 sec |
| N-Methyl Imidazole | 186 | 233 µL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 µL | 100 sec | 300 sec | 300 sec |
| Acetonitrile | NA | 6.67 mL | NA | NA | NA |

| B. 0.2 µmol Synthesis Cycle ABI 394 Instrument | | | | | |
|---|---|---|---|---|---|
| Reagent | Equivalents | Amount | Wait Time* DNA | Wait Time* 2'-O-methyl | Wait Time* RNA |
| Phosphoramidites | 15 | 31 µL | 45 sec | 233 sec | 465 sec |
| S-Ethyl Tetrazole | 38.7 | 31 µL | 45 sec | 233 min | 465 sec |
| Acetic Anhydride | 655 | 124 µL | 5 sec | 5 sec | 5 sec |
| N-Methyl Imidazole | 1245 | 124 µL | 5 sec | 5 sec | 5 sec |
| TCA | 700 | 732 µL | 10 sec | 10 sec | 10 sec |
| Iodine | 20.6 | 244 µL | 15 sec | 15 sec | 15 sec |
| Beaucage | 7.7 | 232 µL | 100 sec | 300 sec | 300 sec |
| Acetonitrile | NA | 2.64 mL | NA | NA | NA |

| C. 0.2 µmol Synthesis Cycle 96 well Instrument | | | | | |
|---|---|---|---|---|---|
| Reagent | Equivalents: DNA/2'-O-methyl/Ribo | Amount: DNA/2'-O-methyl/Ribo | Wait Time* DNA | Wait Time* 2'-O-methyl | Wait Time* Ribo |
| Phosphoramidites | 22/33/66 | 40/60/120 µL | 60 sec | 180 sec | 360 sec |
| S-Ethyl Tetrazole | 70/105/210 | 40/60/120 µL | 60 sec | 180 min | 360 sec |
| Acetic Anhydride | 265/265/265 | 50/50/50 µL | 10 sec | 10 sec | 10 sec |
| N-Methyl Imidazole | 502/502/502 | 50/50/50 µL | 10 sec | 10 sec | 10 sec |
| TCA | 238/475/475 | 250/500/500 µL | 15 sec | 15 sec | 15 sec |
| Iodine | 6.8/6.8/6.8 | 80/80/80 µL | 30 sec | 30 sec | 30 sec |
| Beaucage | 34/51/51 | 80/120/120 µL | 100 sec | 200 sec | 200 sec |
| Acetonitrile | NA | 1150/1150/1150 µL | NA | NA | NA |

Wait time does not include contact time during delivery.
Tandem synthesis utilizes double coupling of linker molecule

SEQUENCE LISTING (4252 sequences)

SEQ ID NO: 1 - RNA, 19 nt, Artificial Sequence
  Description of Artificial Sequence:  synthetic
gcggacacuccucucggcu

SEQ ID NO: 2 - RNA, 19 nt, Artificial Sequence
  Description of Artificial Sequence:  synthetic
uccuccccggcagcggcgg

SEQ ID NO: 3 - RNA, 19 nt, Artificial Sequence
  Description of Artificial Sequence:  synthetic
gcggcucggagcgggcucc

SEQ ID NO: 4 - RNA, 19 nt, Artificial Sequence
  Description of Artificial Sequence:  synthetic
cggggcucgggugcagcgg

SEQ ID NO: 5 - RNA, 19 nt, Artificial Sequence
  Description of Artificial Sequence:  synthetic
gccagcgggccuggcggcg

SEQ ID NO: 6 - RNA, 19 nt, Artificial Sequence
  Description of Artificial Sequence:  synthetic
gaggauuacccggggaagu

SEQ ID NO: 7 - RNA, 19 nt, Artificial Sequence
  Description of Artificial Sequence:  synthetic
ugguugucuccuggcugga

SEQ ID NO: 8 - RNA, 19 nt, Artificial Sequence
  Description of Artificial Sequence:  synthetic
agccgcgagacgggcgcuc

SEQ ID NO: 9 - RNA, 19 nt, Artificial Sequence
  Description of Artificial Sequence:  synthetic
cagggcgcggggccggcgg

SEQ ID NO: 10 - RNA, 19 nt, Artificial Sequence
  Description of Artificial Sequence:  synthetic
gcggcgaacgagaggacgg

SEQ ID NO: 11 - RNA, 19 nt, Artificial Sequence
  Description of Artificial Sequence:  synthetic
gacucuggcggccgggucg

SEQ ID NO: 12 - RNA, 19 nt, Artificial Sequence
  Description of Artificial Sequence:  synthetic
guuggccgggggagcgcgg

SEQ ID NO: 13 - RNA, 19 nt, Artificial Sequence
  Description of Artificial Sequence:  synthetic
ggcaccgggcgagcaggcc

SEQ ID NO: 14 - RNA, 19 nt, Artificial Sequence
  Description of Artificial Sequence:  synthetic
cgcgucgcgcucaccaugg

SEQ ID NO: 15 - RNA, 19 nt, Artificial Sequence
  Description of Artificial Sequence:  synthetic
gucagcuacugggacaccg

SEQ ID NO: 16 - RNA, 19 nt, Artificial Sequence
  Description of Artificial Sequence:  synthetic
gggguccugcugugcgcgc

SEQ ID NO: 17 - RNA, 19 nt, Artificial Sequence
  Description of Artificial Sequence:  synthetic
cugcucagcugucugcuuc

SEQ ID NO: 18 - RNA, 19 nt, Artificial Sequence
  Description of Artificial Sequence:  synthetic
cucacaggaucuaguucag

SEQ ID NO: 19 - RNA, 19 nt, Artificial Sequence
  Description of Artificial Sequence:  synthetic
gguucaaaauuaaaagauc

SEQ ID NO: 20 - RNA, 19 nt, Artificial Sequence
  Description of Artificial Sequence:  synthetic
ccugaacugaguuuaaaag

SEQ ID NO: 21 - RNA, 19 nt, Artificial Sequence
  Description of Artificial Sequence:  synthetic
ggcacccagcacaucaugc

SEQ ID NO: 22 - RNA, 19 nt, Artificial Sequence
  Description of Artificial Sequence:  synthetic
caagcaggccagacacugc

SEQ ID NO: 23 - RNA, 19 nt, Artificial Sequence
  Description of Artificial Sequence:  synthetic
caucuccaaugcagggggg

SEQ ID NO: 24 - RNA, 19 nt, Artificial Sequence
  Description of Artificial Sequence:  synthetic
gaagcagcccauaaauggu

SEQ ID NO: 25 - RNA, 19 nt, Artificial Sequence
  Description of Artificial Sequence:  synthetic
ucuuugccugaaaugguga

SEQ ID NO: 26 - RNA, 19 nt, Artificial Sequence
  Description of Artificial Sequence:  synthetic
aguaaggaaagcgaaaggc

SEQ ID NO: 27 - RNA, 19 nt, Artificial Sequence
  Description of Artificial Sequence:  synthetic
cugagcauaacuaaaucug

SEQ ID NO: 28 - RNA, 19 nt, Artificial Sequence
  Description of Artificial Sequence:  synthetic
gccuguggaagaaauggca

SEQ ID NO: 29 - RNA, 19 nt, Artificial Sequence
  Description of Artificial Sequence:  synthetic
aaacaauucugcaguacuu

SEQ ID NO: 30 - RNA, 19 nt, Artificial Sequence
  Description of Artificial Sequence:  synthetic
uuaaccuugaacacagcuc

SEQ ID NO: 31 - RNA, 19 nt, Artificial Sequence
  Description of Artificial Sequence:  synthetic
caagcaaaccacacuggcu

SEQ ID NO: 32 - RNA, 19 nt, Artificial Sequence
  Description of Artificial Sequence:  synthetic
uucuacagcugcaaauauc

SEQ ID NO: 33 - RNA, 19 nt, Artificial Sequence
  Description of Artificial Sequence:  synthetic
cuagcuguaccuacuucaa

SEQ ID NO: 34 - RNA, 19 nt, Artificial Sequence
  Description of Artificial Sequence:  synthetic
aagaagaaggaaacagaau

SEQ ID NO: 35 - RNA, 19 nt, Artificial Sequence
  Description of Artificial Sequence:  synthetic
ucugcaaucuauauauuua

SEQ ID NO: 36 - RNA, 19 nt, Artificial Sequence
  Description of Artificial Sequence:  synthetic
auuagugauacagguagac

SEQ ID NO: 37 - RNA, 19 nt, Artificial Sequence
  Description of Artificial Sequence:  synthetic
ccuuucguagagauguaca

SEQ ID NO: 38 - RNA, 19 nt, Artificial Sequence
  Description of Artificial Sequence:  synthetic
agugaaauccccgaaauua

SEQ ID NO: 39 - RNA, 19 nt, Artificial Sequence
  Description of Artificial Sequence:  synthetic
auacacaugacugaaggaa

SEQ ID NO: 40 - RNA, 19 nt, Artificial Sequence
  Description of Artificial Sequence:  synthetic
agggagcucgucauucccu

SEQ ID NO: 41 - RNA, 19 nt, Artificial Sequence
  Description of Artificial Sequence:  synthetic
ugccggguuacgucaccua

SEQ ID NO: 42 - RNA, 19 nt, Artificial Sequence
  Description of Artificial Sequence:  synthetic
aacaucacuguuacuuuaa

SEQ ID NO: 43 - RNA, 19 nt, Artificial Sequence
  Description of Artificial Sequence:  synthetic
aaaaaguuuccacuugaca

SEQ ID NO: 44 - RNA, 19 nt, Artificial Sequence
  Description of Artificial Sequence:  synthetic
acuuugaucccugauggaa

SEQ ID NO: 45 - RNA, 19 nt, Artificial Sequence
  Description of Artificial Sequence:  synthetic
aaacgcauaaucugggaca

SEQ ID NO: 46 - RNA, 19 nt, Artificial Sequence
  Description of Artificial Sequence:  synthetic
aguagaaagggcuucauca

SEQ ID NO: 47 - RNA, 19 nt, Artificial Sequence
  Description of Artificial Sequence:  synthetic
auaucaaaugcaacguaca

SEQ ID NO: 48 - RNA, 19 nt, Artificial Sequence
  Description of Artificial Sequence:  synthetic
aaagaaauagggcuucuga

SEQ ID NO: 49 - RNA, 19 nt, Artificial Sequence
  Description of Artificial Sequence:  synthetic
accugugaagcaacaguca

SEQ ID NO: 50 - RNA, 19 nt, Artificial Sequence
  Description of Artificial Sequence:  synthetic
aaugggcauuuguauaaga

SEQ ID NO: 51 - RNA, 19 nt, Artificial Sequence
  Description of Artificial Sequence:  synthetic
acaaacuaucucacacauc

SEQ ID NO: 52 - RNA, 19 nt, Artificial Sequence
  Description of Artificial Sequence:  synthetic
cgacaaaccaauacaauca

SEQ ID NO: 53 - RNA, 19 nt, Artificial Sequence
  Description of Artificial Sequence:  synthetic
auagauguccaaauaagca

SEQ ID NO: 54 - RNA, 19 nt, Artificial Sequence
  Description of Artificial Sequence:  synthetic
acaccacgcccagucaaau

SEQ ID NO: 55 - RNA, 19 nt, Artificial Sequence
  Description of Artificial Sequence:  synthetic
uuacuuagaggccauacuc

SEQ ID NO: 56 - RNA, 19 nt, Artificial Sequence
  Description of Artificial Sequence:  synthetic
cuuguccucaauuguacug

SEQ ID NO: 57 - RNA, 19 nt, Artificial Sequence
  Description of Artificial Sequence:  synthetic
gcuaccacucccuugaaca

SEQ ID NO: 58 - RNA, 19 nt, Artificial Sequence
  Description of Artificial Sequence:  synthetic
acgagaguucaaaugaccu

SEQ ID NO: 59 - RNA, 19 nt, Artificial Sequence
  Description of Artificial Sequence:  synthetic
uggaguuacccugaugaaa

SEQ ID NO: 60 - RNA, 19 nt, Artificial Sequence
  Description of Artificial Sequence:  synthetic
aaaaauaagagagcuuccg

SEQ ID NO: 61 - RNA, 19 nt, Artificial Sequence
  Description of Artificial Sequence:  synthetic
guaaggcgacgaauugacc

SEQ ID NO: 62 - RNA, 19 nt, Artificial Sequence
  Description of Artificial Sequence:  synthetic
caaagcaauucccaugcca

SEQ ID NO: 63 - RNA, 19 nt, Artificial Sequence
  Description of Artificial Sequence:  synthetic
aacauauucuacaguguuc

SEQ ID NO: 64 - RNA, 19 nt, Artificial Sequence
  Description of Artificial Sequence:  synthetic
cuuacuauugacaaaaugc

SEQ ID NO: 65 - RNA, 19 nt, Artificial Sequence
  Description of Artificial Sequence:  synthetic
cagaacaaagacaaaggac

SEQ ID NO: 66 - RNA, 19 nt, Artificial Sequence
  Description of Artificial Sequence:  synthetic
cuuuauacuugucguguaa

SEQ ID NO: 67 - RNA, 19 nt, Artificial Sequence
  Description of Artificial Sequence:  synthetic
aggaguggaccaucauuca

SEQ ID NO: 68 - RNA, 19 nt, Artificial Sequence
  Description of Artificial Sequence:  synthetic
aaaucuguuaacaccucag

SEQ ID NO: 69 - RNA, 19 nt, Artificial Sequence
  Description of Artificial Sequence:  synthetic
gugcauauauaugauaaag

SEQ ID NO: 70 - RNA, 19 nt, Artificial Sequence
  Description of Artificial Sequence:  synthetic
gcauucaucacugugaaac

SEQ ID NO: 71 - RNA, 19 nt, Artificial Sequence
  Description of Artificial Sequence:  synthetic
caucgaaaacagcaggugc

SEQ ID NO: 72 - RNA, 19 nt, Artificial Sequence
  Description of Artificial Sequence:  synthetic
cuugaaaccguagcuggca

SEQ ID NO: 73 - RNA, 19 nt, Artificial Sequence
  Description of Artificial Sequence:  synthetic
aagcggucuuaccggcucu

SEQ ID NO: 74 - RNA, 19 nt, Artificial Sequence
  Description of Artificial Sequence:  synthetic
ucuaugaaagugaaggcau

SEQ ID NO: 75 - RNA, 19 nt, Artificial Sequence
  Description of Artificial Sequence:  synthetic
uuucccucgccggaaguug

SEQ ID NO: 76 - RNA, 19 nt, Artificial Sequence
  Description of Artificial Sequence:  synthetic
guaugguuaaaagaugggu

SEQ ID NO: 77 - RNA, 19 nt, Artificial Sequence
  Description of Artificial Sequence:  synthetic
uuaccugcgacugagaaau

SEQ ID NO: 78 - RNA, 19 nt, Artificial Sequence
  Description of Artificial Sequence:  synthetic
ucugcucgcuauuugacuc

SEQ ID NO: 79 - RNA, 19 nt, Artificial Sequence
  Description of Artificial Sequence:  synthetic
cguggcuacucguuaauua

SEQ ID NO: 80 - RNA, 19 nt, Artificial Sequence
  Description of Artificial Sequence:  synthetic
aucaaggacguaacugaag

SEQ ID NO: 81 - RNA, 19 nt, Artificial Sequence
  Description of Artificial Sequence:  synthetic
gaggaugcagggaauuaua

SEQ ID NO: 82 - RNA, 19 nt, Artificial Sequence
  Description of Artificial Sequence:  synthetic
acaaucuugcugagcauaa

SEQ ID NO: 83 - RNA, 19 nt, Artificial Sequence
  Description of Artificial Sequence:  synthetic
aaacagucaaauguguuua

SEQ ID NO: 84 - RNA, 19 nt, Artificial Sequence
  Description of Artificial Sequence:  synthetic
aaaaaccucacugccacuc

SEQ ID NO: 85 - RNA, 19 nt, Artificial Sequence
  Description of Artificial Sequence:  synthetic
cuaauugucaaugugaaac

SEQ ID NO: 86 - RNA, 19 nt, Artificial Sequence
  Description of Artificial Sequence:  synthetic
ccccagauuuacgaaaagg

SEQ ID NO: 87 - RNA, 19 nt, Artificial Sequence
  Description of Artificial Sequence:  synthetic
gccgugucaucguuuccag

SEQ ID NO: 88 - RNA, 19 nt, Artificial Sequence
  Description of Artificial Sequence:  synthetic
gacccggcucucuacccac

SEQ ID NO: 89 - RNA, 19 nt, Artificial Sequence
  Description of Artificial Sequence:  synthetic
cugggcagcagacaaaucc

SEQ ID NO: 90 - RNA, 19 nt, Artificial Sequence
  Description of Artificial Sequence:  synthetic
cugacuuguaccgcauaug

SEQ ID NO: 91 - RNA, 19 nt, Artificial Sequence
  Description of Artificial Sequence:  synthetic
gguaucccucaaccuacaa

SEQ ID NO: 92 - RNA, 19 nt, Artificial Sequence
  Description of Artificial Sequence:  synthetic
aucaagugguucuggcacc

SEQ ID NO: 93 - RNA, 19 nt, Artificial Sequence
  Description of Artificial Sequence:  synthetic
cccuguaaccauaaucauu

SEQ ID NO: 94 - RNA, 19 nt, Artificial Sequence
  Description of Artificial Sequence:  synthetic
uccgaagcaaggugugacu

SEQ ID NO: 95 - RNA, 19 nt, Artificial Sequence
  Description of Artificial Sequence:  synthetic
uuuuguuccaauaaugaag

SEQ ID NO: 96 - RNA, 19 nt, Artificial Sequence
  Description of Artificial Sequence:  synthetic
gaguccuuuauccuggaug

SEQ ID NO: 97 - RNA, 19 nt, Artificial Sequence
  Description of Artificial Sequence:  synthetic
gcugacagcaacaugggaa

SEQ ID NO: 98 - RNA, 19 nt, Artificial Sequence
  Description of Artificial Sequence:  synthetic
aacagaauugagagcauca

SEQ ID NO: 99 - RNA, 19 nt, Artificial Sequence
  Description of Artificial Sequence:  synthetic
acucagcgcauggcaauaa

SEQ ID NO: 100 - RNA, 19 nt, Artificial Sequence
  Description of Artificial Sequence:  synthetic
auagaaggaaagaauaaga

SEQ ID NO: 101 - RNA, 19 nt, Artificial Sequence
  Description of Artificial Sequence:  synthetic
auggcuagcaccuugguug

SEQ ID NO: 102 - RNA, 19 nt, Artificial Sequence
  Description of Artificial Sequence:  synthetic
guggcugacucuagaauuu

SEQ ID NO: 103 - RNA, 19 nt, Artificial Sequence
  Description of Artificial Sequence:  synthetic
ucuggaaucuacauuugca

SEQ ID NO: 104 - RNA, 19 nt, Artificial Sequence
  Description of Artificial Sequence:  synthetic
auagcuuccaauaaaguug

SEQ ID NO: 105 - RNA, 19 nt, Artificial Sequence
  Description of Artificial Sequence:  synthetic
gggacugugggaagaaaca

SEQ ID NO: 106 - RNA, 19 nt, Artificial Sequence
  Description of Artificial Sequence:  synthetic
auaagcuuuuauaucacag

SEQ ID NO: 107 - RNA, 19 nt, Artificial Sequence
  Description of Artificial Sequence:  synthetic
gaugugccaaauggguuuc

SEQ ID NO: 108 - RNA, 19 nt, Artificial Sequence
  Description of Artificial Sequence:  synthetic
cauguuaacuuggaaaaaa

SEQ ID NO: 109 - RNA, 19 nt, Artificial Sequence
  Description of Artificial Sequence:  synthetic
augccgacggaaggagagg

SEQ ID NO: 110 - RNA, 19 nt, Artificial Sequence
  Description of Artificial Sequence:  synthetic
gaccugaaacugucuugca

SEQ ID NO: 111 - RNA, 19 nt, Artificial Sequence
  Description of Artificial Sequence:  synthetic
acaguuaacaaguucuuau

SEQ ID NO: 112 - RNA, 19 nt, Artificial Sequence
  Description of Artificial Sequence:  synthetic
uacagagacguuacuugga

SEQ ID NO: 113 - RNA, 19 nt, Artificial Sequence
  Description of Artificial Sequence:  synthetic
auuuuacugcggacaguua

SEQ ID NO: 114 - RNA, 19 nt, Artificial Sequence
  Description of Artificial Sequence:  synthetic
aauaacagaacaaugcacu

SEQ ID NO: 115 - RNA, 19 nt, Artificial Sequence
  Description of Artificial Sequence:  synthetic
uacaguauuagcaagcaaa

SEQ ID NO: 116 - RNA, 19 nt, Artificial Sequence
  Description of Artificial Sequence:  synthetic
aaaauggccaucacuaagg

SEQ ID NO: 117 - RNA, 19 nt, Artificial Sequence
  Description of Artificial Sequence:  synthetic
gagcacuccaucacucuua

SEQ ID NO: 118 - RNA, 19 nt, Artificial Sequence
  Description of Artificial Sequence:  synthetic
aaucuuaccaucaugaaug

SEQ ID NO: 119 - RNA, 19 nt, Artificial Sequence
  Description of Artificial Sequence:  synthetic
guuucccugcaagauucag

SEQ ID NO: 120 - RNA, 19 nt, Artificial Sequence
  Description of Artificial Sequence:  synthetic
ggcaccuaugccugcagag

SEQ ID NO: 121 - RNA, 19 nt, Artificial Sequence
  Description of Artificial Sequence:  synthetic
gccaggaauguauacacag

SEQ ID NO: 122 - RNA, 19 nt, Artificial Sequence
  Description of Artificial Sequence:  synthetic
ggggaagaaauccuccaga

SEQ ID NO: 123 - RNA, 19 nt, Artificial Sequence
  Description of Artificial Sequence:  synthetic
aagaaagaaauuacaauca

SEQ ID NO: 124 - RNA, 19 nt, Artificial Sequence
  Description of Artificial Sequence:  synthetic
agagaucaggaagcaccau

SEQ ID NO: 125 - RNA, 19 nt, Artificial Sequence
  Description of Artificial Sequence:  synthetic
uaccuccugcgaaaccuca

SEQ ID NO: 126 - RNA, 19 nt, Artificial Sequence
  Description of Artificial Sequence:  synthetic
agugaucacacaguggcca

SEQ ID NO: 127 - RNA, 19 nt, Artificial Sequence
  Description of Artificial Sequence:  synthetic
aucagcaguuccaccacuu

SEQ ID NO: 128 - RNA, 19 nt, Artificial Sequence
  Description of Artificial Sequence:  synthetic
uuagacugucaugcuaaug

SEQ ID NO: 129 - RNA, 19 nt, Artificial Sequence
  Description of Artificial Sequence:  synthetic
gguguccccgagccucaga

SEQ ID NO: 130 - RNA, 19 nt, Artificial Sequence
  Description of Artificial Sequence:  synthetic
aucacuugguuuaaaaaca

SEQ ID NO: 131 - RNA, 19 nt, Artificial Sequence
  Description of Artificial Sequence:  synthetic
aaccacaaaauacaacaag

SEQ ID NO: 132 - RNA, 19 nt, Artificial Sequence
  Description of Artificial Sequence:  synthetic
gagccuggaauuauuuuag

SEQ ID NO: 133 - RNA, 19 nt, Artificial Sequence
  Description of Artificial Sequence:  synthetic
ggaccaggaagcagcacgc

SEQ ID NO: 134 - RNA, 19 nt, Artificial Sequence
  Description of Artificial Sequence:  synthetic
cuguuuauugaaagaguca

SEQ ID NO: 135 - RNA, 19 nt, Artificial Sequence
  Description of Artificial Sequence:  synthetic
acagaagaggaugaaggug

SEQ ID NO: 136 - RNA, 19 nt, Artificial Sequence
  Description of Artificial Sequence:  synthetic
gucuaucacugcaaagcca

SEQ ID NO: 137 - RNA, 19 nt, Artificial Sequence
  Description of Artificial Sequence:  synthetic
accaaccagaagggcucug

SEQ ID NO: 138 - RNA, 19 nt, Artificial Sequence
  Description of Artificial Sequence:  synthetic
guggaaaguucagcauacc

SEQ ID NO: 139 - RNA, 19 nt, Artificial Sequence
  Description of Artificial Sequence:  synthetic
cucacuguucaaggaaccu

SEQ ID NO: 140 - RNA, 19 nt, Artificial Sequence
  Description of Artificial Sequence:  synthetic
ucggacaagucuaaucugg

SEQ ID NO: 141 - RNA, 19 nt, Artificial Sequence
  Description of Artificial Sequence:  synthetic
gagcugaucacucuaacau

SEQ ID NO: 142 - RNA, 19 nt, Artificial Sequence
  Description of Artificial Sequence:  synthetic
ugcaccuguguggcugcga

SEQ ID NO: 143 - RNA, 19 nt, Artificial Sequence
  Description of Artificial Sequence:  synthetic
acucucuucuggcuccuau

SEQ ID NO: 144 - RNA, 19 nt, Artificial Sequence
  Description of Artificial Sequence:  synthetic
uuaacccuccuuauccgaa

SEQ ID NO: 145 - RNA, 19 nt, Artificial Sequence
  Description of Artificial Sequence:  synthetic
aaaaugaaaaggucuucuu

SEQ ID NO: 146 - RNA, 19 nt, Artificial Sequence
  Description of Artificial Sequence:  synthetic
ucugaaauaaagacugacu

SEQ ID NO: 147 - RNA, 19 nt, Artificial Sequence
  Description of Artificial Sequence:  synthetic
uaccuaucaauuauaaugg

SEQ ID NO: 148 - RNA, 19 nt, Artificial Sequence
  Description of Artificial Sequence:  synthetic
gacccagaugaaguuccuu

SEQ ID NO: 149 - RNA, 19 nt, Artificial Sequence
  Description of Artificial Sequence:  synthetic
uuggaugagcagugugagc

SEQ ID NO: 150 - RNA, 19 nt, Artificial Sequence
  Description of Artificial Sequence:  synthetic
cggcucccuuaugaugcca

SEQ ID NO: 151 - RNA, 19 nt, Artificial Sequence
  Description of Artificial Sequence:  synthetic
agcaagugggaguuugccc

SEQ ID NO: 152 - RNA, 19 nt, Artificial Sequence
  Description of Artificial Sequence:  synthetic
cgggagagacuuaaacugg

SEQ ID NO: 153 - RNA, 19 nt, Artificial Sequence
  Description of Artificial Sequence:  synthetic
ggcaaaucacuuggaagag

SEQ ID NO: 154 - RNA, 19 nt, Artificial Sequence
  Description of Artificial Sequence:  synthetic
ggggcuuuuggaaaagugg

SEQ ID NO: 155 - RNA, 19 nt, Artificial Sequence
  Description of Artificial Sequence:  synthetic
guucaagcaucagcauuug

SEQ ID NO: 156 - RNA, 19 nt, Artificial Sequence
  Description of Artificial Sequence:  synthetic
ggcauuaagaaaucaccua

SEQ ID NO: 157 - RNA, 19 nt, Artificial Sequence
  Description of Artificial Sequence:  synthetic
acgugccggacuguggcug

SEQ ID NO: 158 - RNA, 19 nt, Artificial Sequence
  Description of Artificial Sequence:  synthetic
gugaaaaugcugaaagagg

SEQ ID NO: 159 - RNA, 19 nt, Artificial Sequence
  Description of Artificial Sequence:  synthetic
ggggccacggccagcgagu

SEQ ID NO: 160 - RNA, 19 nt, Artificial Sequence
  Description of Artificial Sequence:  synthetic
uacaaagcucugaugacug

SEQ ID NO: 161 - RNA, 19 nt, Artificial Sequence
  Description of Artificial Sequence:  synthetic
gagcuaaaaaucuugaccc

SEQ ID NO: 162 - RNA, 19 nt, Artificial Sequence
  Description of Artificial Sequence:  synthetic
cacauuggccaccaucuga

SEQ ID NO: 163 - RNA, 19 nt, Artificial Sequence
  Description of Artificial Sequence:  synthetic
aacgugguuaaccugcugg

SEQ ID NO: 164 - RNA, 19 nt, Artificial Sequence
  Description of Artificial Sequence:  synthetic
ggagccugcaccaagcaag

SEQ ID NO: 165 - RNA, 19 nt, Artificial Sequence
  Description of Artificial Sequence:  synthetic
ggagggccucugaugguga

SEQ ID NO: 166 - RNA, 19 nt, Artificial Sequence
  Description of Artificial Sequence:  synthetic
auuguugaauacugcaaau

SEQ ID NO: 167 - RNA, 19 nt, Artificial Sequence
  Description of Artificial Sequence:  synthetic
uauggaaaucucuccaacu

SEQ ID NO: 168 - RNA, 19 nt, Artificial Sequence
  Description of Artificial Sequence:  synthetic
uaccucaagagcaaacgug

SEQ ID NO: 169 - RNA, 19 nt, Artificial Sequence
  Description of Artificial Sequence:  synthetic
gacuuauuuuuucucaaca

SEQ ID NO: 170 - RNA, 19 nt, Artificial Sequence
  Description of Artificial Sequence:  synthetic
aaggaugcagcacuacaca

SEQ ID NO: 171 - RNA, 19 nt, Artificial Sequence
  Description of Artificial Sequence:  synthetic
auggagccuaagaaagaaa

SEQ ID NO: 172 - RNA, 19 nt, Artificial Sequence
  Description of Artificial Sequence:  synthetic
aaaauggagccaggccugg

SEQ ID NO: 173 - RNA, 19 nt, Artificial Sequence
  Description of Artificial Sequence:  synthetic
gaacaaggcaagaaaccaa

SEQ ID NO: 174 - RNA, 19 nt, Artificial Sequence
  Description of Artificial Sequence:  synthetic
agacuagauagcgucacca

SEQ ID NO: 175 - RNA, 19 nt, Artificial Sequence
  Description of Artificial Sequence:  synthetic
agcagcgaaagcuuugcga

SEQ ID NO: 176 - RNA, 19 nt, Artificial Sequence
  Description of Artificial Sequence:  synthetic
agcuccggcuuucaggaag

SEQ ID NO: 177 - RNA, 19 nt, Artificial Sequence
  Description of Artificial Sequence:  synthetic
gauaaaagucugagugaug

SEQ ID NO: 178 - RNA, 19 nt, Artificial Sequence
  Description of Artificial Sequence:  synthetic
guugaggaagaggaggauu

SEQ ID NO: 179 - RNA, 19 nt, Artificial Sequence
  Description of Artificial Sequence:  synthetic
ucugacgguuucuacaagg

SEQ ID NO: 180 - RNA, 19 nt, Artificial Sequence
  Description of Artificial Sequence:  synthetic
gagcccaucacuauggaag

SEQ ID NO: 181 - RNA, 19 nt, Artificial Sequence
  Description of Artificial Sequence:  synthetic
gaucugauuucuuacaguu

SEQ ID NO: 182 - RNA, 19 nt, Artificial Sequence
  Description of Artificial Sequence:  synthetic
uuucaaguggccagaggca

SEQ ID NO: 183 - RNA, 19 nt, Artificial Sequence
  Description of Artificial Sequence:  synthetic
auggaguuccugucuucca

SEQ ID NO: 184 - RNA, 19 nt, Artificial Sequence
  Description of Artificial Sequence:  synthetic
agaaagugcauucaucggg

SEQ ID NO: 185 - RNA, 19 nt, Artificial Sequence
  Description of Artificial Sequence:  synthetic
gaccuggcagcgagaaaca

SEQ ID NO: 186 - RNA, 19 nt, Artificial Sequence
  Description of Artificial Sequence:  synthetic
auucuuuuaucugagaaca

SEQ ID NO: 187 - RNA, 19 nt, Artificial Sequence
  Description of Artificial Sequence:  synthetic
aacguggugaagauuugug

SEQ ID NO: 188 - RNA, 19 nt, Artificial Sequence
  Description of Artificial Sequence:  synthetic
gauuuuggccuugcccggg

SEQ ID NO: 189 - RNA, 19 nt, Artificial Sequence
  Description of Artificial Sequence:  synthetic
gauauuuauaagaaccccg

SEQ ID NO: 190 - RNA, 19 nt, Artificial Sequence
  Description of Artificial Sequence:  synthetic
gauuaugugagaaaaggag

SEQ ID NO: 191 - RNA, 19 nt, Artificial Sequence
  Description of Artificial Sequence:  synthetic
gauacucgacuuccucuga

SEQ ID NO: 192 - RNA, 19 nt, Artificial Sequence
  Description of Artificial Sequence:  synthetic
aaauggauggcucccgaau

SEQ ID NO: 193 - RNA, 19 nt, Artificial Sequence
  Description of Artificial Sequence:  synthetic
ucuaucuuugacaaaaucu

SEQ ID NO: 194 - RNA, 19 nt, Artificial Sequence
  Description of Artificial Sequence:  synthetic
uacagcaccaagagcgacg

SEQ ID NO: 195 - RNA, 19 nt, Artificial Sequence
  Description of Artificial Sequence:  synthetic
guguggucuuacggaguau

SEQ ID NO: 196 - RNA, 19 nt, Artificial Sequence
  Description of Artificial Sequence:  synthetic
uugcugugggaaaucuucu

SEQ ID NO: 197 - RNA, 19 nt, Artificial Sequence
  Description of Artificial Sequence:  synthetic
uccuuaggugggucuccau

SEQ ID NO: 198 - RNA, 19 nt, Artificial Sequence
  Description of Artificial Sequence:  synthetic
uacccaggaguacaaaugg

SEQ ID NO: 199 - RNA, 19 nt, Artificial Sequence
  Description of Artificial Sequence:  synthetic
gaugaggacuuuugcaguc

SEQ ID NO: 200 - RNA, 19 nt, Artificial Sequence
  Description of Artificial Sequence:  synthetic
cgccugagggaaggcauga

SEQ ID NO: 201 - RNA, 19 nt, Artificial Sequence
  Description of Artificial Sequence:  synthetic
aggaugagagcuccugagu

SEQ ID NO: 202 - RNA, 19 nt, Artificial Sequence
  Description of Artificial Sequence:  synthetic
uacucuacuccugaaaucu

SEQ ID NO: 203 - RNA, 19 nt, Artificial Sequence
  Description of Artificial Sequence:  synthetic
uaucagaucaugcuggacu

SEQ ID NO: 204 - RNA, 19 nt, Artificial Sequence
  Description of Artificial Sequence:  synthetic
ugcuggcacagagacccaa

SEQ ID NO: 205 - RNA, 19 nt, Artificial Sequence
  Description of Artificial Sequence:  synthetic
aaagaaaggccaagauuug

SEQ ID NO: 206 - RNA, 19 nt, Artificial Sequence
  Description of Artificial Sequence:  synthetic
gcagaacuuguggaaaaac

SEQ ID NO: 207 - RNA, 19 nt, Artificial Sequence
  Description of Artificial Sequence:  synthetic
cuaggugauuugcuucaag

SEQ ID NO: 208 - RNA, 19 nt, Artificial Sequence
  Description of Artificial Sequence:  synthetic
gcaaauguacaacaggaug

SEQ ID NO: 209 - RNA, 19 nt, Artificial Sequence
  Description of Artificial Sequence:  synthetic
gguaaagacuacaucccaa

SEQ ID NO: 210 - RNA, 19 nt, Artificial Sequence
  Description of Artificial Sequence:  synthetic
aucaaugccauacugacag

SEQ ID NO: 211 - RNA, 19 nt, Artificial Sequence
  Description of Artificial Sequence:  synthetic
ggaaauaguggguuuacau

SEQ ID NO: 212 - RNA, 19 nt, Artificial Sequence
  Description of Artificial Sequence:  synthetic
uacucaacuccugccuucu

SEQ ID NO: 213 - RNA, 19 nt, Artificial Sequence
  Description of Artificial Sequence:  synthetic
ucugaggacuucuucaagg

SEQ ID NO: 214 - RNA, 19 nt, Artificial Sequence
  Description of Artificial Sequence:  synthetic
gaaaguauuucagcuccga

SEQ ID NO: 215 - RNA, 19 nt, Artificial Sequence
  Description of Artificial Sequence:  synthetic
aaguuuaauucaggaagcu

SEQ ID NO: 216 - RNA, 19 nt, Artificial Sequence
  Description of Artificial Sequence:  synthetic
ucugaugaugucagauaug

SEQ ID NO: 217 - RNA, 19 nt, Artificial Sequence
  Description of Artificial Sequence:  synthetic
guaaaugcuuucaaguuca

SEQ ID NO: 218 - RNA, 19 nt, Artificial Sequence
  Description of Artificial Sequence:  synthetic
augagccuggaaagaauca

SEQ ID NO: 219 - RNA, 19 nt, Artificial Sequence
  Description of Artificial Sequence:  synthetic
aaaaccuuugaagaacuuu

SEQ ID NO: 220 - RNA, 19 nt, Artificial Sequence
  Description of Artificial Sequence:  synthetic
uuaccgaaugccaccucca

SEQ ID NO: 221 - RNA, 19 nt, Artificial Sequence
  Description of Artificial Sequence:  synthetic
auguuugaugacuaccagg

SEQ ID NO: 222 - RNA, 19 nt, Artificial Sequence
  Description of Artificial Sequence:  synthetic
ggcgacagcagcacucugu

SEQ ID NO: 223 - RNA, 19 nt, Artificial Sequence
  Description of Artificial Sequence:  synthetic
uuggccucucccaugcuga

SEQ ID NO: 224 - RNA, 19 nt, Artificial Sequence
  Description of Artificial Sequence:  synthetic
aagcgcuucaccuggacug

SEQ ID NO: 225 - RNA, 19 nt, Artificial Sequence
  Description of Artificial Sequence:  synthetic
gacagcaaacccaaggccu

SEQ ID NO: 226 - RNA, 19 nt, Artificial Sequence
  Description of Artificial Sequence:  synthetic
ucgcucaagauugacuuga

SEQ ID NO: 227 - RNA, 19 nt, Artificial Sequence
  Description of Artificial Sequence:  synthetic
agaguaaccaguaaaagua

SEQ ID NO: 228 - RNA, 19 nt, Artificial Sequence
  Description of Artificial Sequence:  synthetic
aaggagucggggcugucug

SEQ ID NO: 229 - RNA, 19 nt, Artificial Sequence
  Description of Artificial Sequence:  synthetic
gaugucagcaggcccaguu

SEQ ID NO: 230 - RNA, 19 nt, Artificial Sequence
  Description of Artificial Sequence:  synthetic
uucugccauuccagcugug

SEQ ID NO: 231 - RNA, 19 nt, Artificial Sequence
  Description of Artificial Sequence:  synthetic
gggcacgucagcgaaggca

SEQ ID NO: 232 - RNA, 19 nt, Artificial Sequence
  Description of Artificial Sequence:  synthetic
aagcgcagguucaccuacg

SEQ ID NO: 233 - RNA, 19 nt, Artificial Sequence
  Description of Artificial Sequence:  synthetic
gaccacgcugagcuggaaa

SEQ ID NO: 234 - RNA, 19 nt, Artificial Sequence
  Description of Artificial Sequence:  synthetic
aggaaaaucgcgugcugcu

SEQ ID NO: 235 - RNA, 19 nt, Artificial Sequence
  Description of Artificial Sequence:  synthetic
uccccgcccccagacuaca

SEQ ID NO: 236 - RNA, 19 nt, Artificial Sequence
  Description of Artificial Sequence:  synthetic
aacucggugguccuguacu

SEQ ID NO: 237 - RNA, 19 nt, Artificial Sequence
  Description of Artificial Sequence:  synthetic
uccaccccacccaucuaga

SEQ ID NO: 238 - RNA, 19 nt, Artificial Sequence
  Description of Artificial Sequence:  synthetic
aguuugacacgaagccuua

SEQ ID NO: 239 - RNA, 19 nt, Artificial Sequence
  Description of Artificial Sequence:  synthetic
auuucuagaagcacaugug

SEQ ID NO: 240 - RNA, 19 nt, Artificial Sequence
  Description of Artificial Sequence:  synthetic
guauuuauacccccaggaa

SEQ ID NO: 241 - RNA, 19 nt, Artificial Sequence
  Description of Artificial Sequence:  synthetic
aacuagcuuuugccaguau

SEQ ID NO: 242 - RNA, 19 nt, Artificial Sequence
  Description of Artificial Sequence:  synthetic
uuaugcauauauaaguuua

SEQ ID NO: 243 - RNA, 19 nt, Artificial Sequence
  Description of Artificial Sequence:  synthetic
acaccuuuaucuuuccaug

SEQ ID NO: 244 - RNA, 19 nt, Artificial Sequence
  Description of Artificial Sequence:  synthetic
gggagccagcugcuuuuug

SEQ ID NO: 245 - RNA, 19 nt, Artificial Sequence
  Description of Artificial Sequence:  synthetic
gugauuuuuuuaauagugc

SEQ ID NO: 246 - RNA, 19 nt, Artificial Sequence
  Description of Artificial Sequence:  synthetic
cuuuuuuuuuuugacuaac

SEQ ID NO: 247 - RNA, 19 nt, Artificial Sequence
  Description of Artificial Sequence:  synthetic
caagaauguaacuccagau

SEQ ID NO: 248 - RNA, 19 nt, Artificial Sequence
  Description of Artificial Sequence:  synthetic
uagagaaauagugacaagu

SEQ ID NO: 249 - RNA, 19 nt, Artificial Sequence
  Description of Artificial Sequence:  synthetic
ugaagaacacuacugcuaa

SEQ ID NO: 250 - RNA, 19 nt, Artificial Sequence
  Description of Artificial Sequence:  synthetic
aauccucauguuacucagu

SEQ ID NO: 251 - RNA, 19 nt, Artificial Sequence
  Description of Artificial Sequence:  synthetic
uguuagagaaauccuuccu

SEQ ID NO: 252 - RNA, 19 nt, Artificial Sequence
  Description of Artificial Sequence:  synthetic
uaaacccaaugacuucccu

SEQ ID NO: 253 - RNA, 19 nt, Artificial Sequence
  Description of Artificial Sequence:  synthetic
ugcuccaacccccgccacc

SEQ ID NO: 254 - RNA, 19 nt, Artificial Sequence
  Description of Artificial Sequence:  synthetic
cucagggcacgcaggacca

SEQ ID NO: 255 - RNA, 19 nt, Artificial Sequence
  Description of Artificial Sequence:  synthetic
aguuugauugaggagcugc

SEQ ID NO: 256 - RNA, 19 nt, Artificial Sequence
  Description of Artificial Sequence:  synthetic
cacugaucacccaaugcau

SEQ ID NO: 257 - RNA, 19 nt, Artificial Sequence
  Description of Artificial Sequence:  synthetic
ucacguaccccacugggcc

SEQ ID NO: 258 - RNA, 19 nt, Artificial Sequence
  Description of Artificial Sequence:  synthetic
cagcccugcagcccaaaac

SEQ ID NO: 259 - RNA, 19 nt, Artificial Sequence
  Description of Artificial Sequence:  synthetic
cccagggcaacaagcccgu

SEQ ID NO: 260 - RNA, 19 nt, Artificial Sequence
  Description of Artificial Sequence:  synthetic
uuagccccaggggaucacu

SEQ ID NO: 261 - RNA, 19 nt, Artificial Sequence
  Description of Artificial Sequence:  synthetic
uggcuggccugagcaacau

SEQ ID NO: 262 - RNA, 19 nt, Artificial Sequence
  Description of Artificial Sequence:  synthetic
ucucgggaguccucuagca

SEQ ID NO: 263 - RNA, 19 nt, Artificial Sequence
  Description of Artificial Sequence:  synthetic
aggccuaagacaugugagg

SEQ ID NO: 264 - RNA, 19 nt, Artificial Sequence
  Description of Artificial Sequence:  synthetic
gaggaaaaggaaaaaaagc

SEQ ID NO: 265 - RNA, 19 nt, Artificial Sequence
  Description of Artificial Sequence:  synthetic
caaaaagcaagggagaaaa

SEQ ID NO: 266 - RNA, 19 nt, Artificial Sequence
  Description of Artificial Sequence:  synthetic
agagaaaccgggagaaggc

SEQ ID NO: 267 - RNA, 19 nt, Artificial Sequence
  Description of Artificial Sequence:  synthetic
caugagaaagaauuugaga

SEQ ID NO: 268 - RNA, 19 nt, Artificial Sequence
  Description of Artificial Sequence:  synthetic
acgcaccaugugggcacgg

SEQ ID NO: 269 - RNA, 19 nt, Artificial Sequence
  Description of Artificial Sequence:  synthetic
gagggggacggggcucagc

SEQ ID NO: 270 - RNA, 19 nt, Artificial Sequence
  Description of Artificial Sequence:  synthetic
caaugccauuucaguggcu

SEQ ID NO: 271 - RNA, 19 nt, Artificial Sequence
  Description of Artificial Sequence:  synthetic
uucccagcucugacccuuc

SEQ ID NO: 272 - RNA, 19 nt, Artificial Sequence
  Description of Artificial Sequence:  synthetic
cuacauuugagggcccagc

SEQ ID NO: 273 - RNA, 19 nt, Artificial Sequence
  Description of Artificial Sequence:  synthetic
ccaggagcagauggacagc

SEQ ID NO: 274 - RNA, 19 nt, Artificial Sequence
  Description of Artificial Sequence:  synthetic
cgaugaggggacauuuucu

SEQ ID NO: 275 - RNA, 19 nt, Artificial Sequence
  Description of Artificial Sequence:  synthetic
uggauucugggaggcaaga

SEQ ID NO: 276 - RNA, 19 nt, Artificial Sequence
  Description of Artificial Sequence:  synthetic
aaaaggacaaauaucuuuu

SEQ ID NO: 277 - RNA, 19 nt, Artificial Sequence
  Description of Artificial Sequence:  synthetic
uuuggaacuaaagcaaauu

SEQ ID NO: 278 - RNA, 19 nt, Artificial Sequence
  Description of Artificial Sequence:  synthetic
uuuagaccuuuaccuaugg

SEQ ID NO: 279 - RNA, 19 nt, Artificial Sequence
  Description of Artificial Sequence:  synthetic
gaagugguucuauguccau

SEQ ID NO: 280 - RNA, 19 nt, Artificial Sequence
  Description of Artificial Sequence:  synthetic
uucucauucguggcauguu

SEQ ID NO: 281 - RNA, 19 nt, Artificial Sequence
  Description of Artificial Sequence:  synthetic
uuugauuuguagcacugag

SEQ ID NO: 282 - RNA, 19 nt, Artificial Sequence
  Description of Artificial Sequence:  synthetic
ggguggcacucaacucuga

SEQ ID NO: 283 - RNA, 19 nt, Artificial Sequence
  Description of Artificial Sequence:  synthetic
agcccauacuuuuggcucc

SEQ ID NO: 284 - RNA, 19 nt, Artificial Sequence
  Description of Artificial Sequence:  synthetic
cucuaguaagaugcacuga

SEQ ID NO: 285 - RNA, 19 nt, Artificial Sequence
  Description of Artificial Sequence:  synthetic
aaaacuuagccagaguuag

SEQ ID NO: 286 - RNA, 19 nt, Artificial Sequence
  Description of Artificial Sequence:  synthetic
gguugucuccaggccauga

SEQ ID NO: 287 - RNA, 19 nt, Artificial Sequence
  Description of Artificial Sequence:  synthetic
auggccuuacacugaaaau

SEQ ID NO: 288 - RNA, 19 nt, Artificial Sequence
  Description of Artificial Sequence:  synthetic
ugucacauucuauuuuggg

SEQ ID NO: 289 - RNA, 19 nt, Artificial Sequence
  Description of Artificial Sequence:  synthetic
guauuaauauauaguccag

SEQ ID NO: 290 - RNA, 19 nt, Artificial Sequence
  Description of Artificial Sequence:  synthetic
gacacuuaacucaauuucu

SEQ ID NO: 291 - RNA, 19 nt, Artificial Sequence
  Description of Artificial Sequence:  synthetic
uugguauuauucuguuuug

SEQ ID NO: 292 - RNA, 19 nt, Artificial Sequence
  Description of Artificial Sequence:  synthetic
gcacaguuaguugugaaag

SEQ ID NO: 293 - RNA, 19 nt, Artificial Sequence
  Description of Artificial Sequence:  synthetic
gaaagcugagaagaaugaa

SEQ ID NO: 294 - RNA, 19 nt, Artificial Sequence
  Description of Artificial Sequence:  synthetic
aaaugcaguccugaggaga

SEQ ID NO: 295 - RNA, 19 nt, Artificial Sequence
  Description of Artificial Sequence:  synthetic
aguuuucuccauaucaaaa

SEQ ID NO: 296 - RNA, 19 nt, Artificial Sequence
  Description of Artificial Sequence:  synthetic
acgagggcugauggaggaa

SEQ ID NO: 297 - RNA, 19 nt, Artificial Sequence
  Description of Artificial Sequence:  synthetic
aaaaggucaauaaggucaa

SEQ ID NO: 298 - RNA, 19 nt, Artificial Sequence
  Description of Artificial Sequence:  synthetic
agggaagaccccgucucua

SEQ ID NO: 299 - RNA, 19 nt, Artificial Sequence
  Description of Artificial Sequence:  synthetic
auaccaaccaaaccaauuc

SEQ ID NO: 300 - RNA, 19 nt, Artificial Sequence
  Description of Artificial Sequence:  synthetic
caccaacacaguugggacc

SEQ ID NO: 301 - RNA, 19 nt, Artificial Sequence
  Description of Artificial Sequence:  synthetic
ccaaaacacaggaagucag

SEQ ID NO: 302 - RNA, 19 nt, Artificial Sequence
  Description of Artificial Sequence:  synthetic
gucacguuuccuuuucauu

SEQ ID NO: 303 - RNA, 19 nt, Artificial Sequence
  Description of Artificial Sequence:  synthetic
uuaauggggauuccacuau

SEQ ID NO: 304 - RNA, 19 nt, Artificial Sequence
  Description of Artificial Sequence:  synthetic
ucucacacuaaucugaaag

SEQ ID NO: 305 - RNA, 19 nt, Artificial Sequence
  Description of Artificial Sequence:  synthetic
ggauguggaagagcauuag

SEQ ID NO: 306 - RNA, 19 nt, Artificial Sequence
  Description of Artificial Sequence:  synthetic
gcuggcgcauauuaagcac

SEQ ID NO: 307 - RNA, 19 nt, Artificial Sequence
  Description of Artificial Sequence:  synthetic
cuuuaagcuccuugaguaa

SEQ ID NO: 308 - RNA, 19 nt, Artificial Sequence
  Description of Artificial Sequence:  synthetic
aaaaggugguauguaauuu

SEQ ID NO: 309 - RNA, 19 nt, Artificial Sequence
  Description of Artificial Sequence:  synthetic
uaugcaagguauuucucca

SEQ ID NO: 310 - RNA, 19 nt, Artificial Sequence
  Description of Artificial Sequence:  synthetic
aguugggacucaggauauu

SEQ ID NO: 311 - RNA, 19 nt, Artificial Sequence
  Description of Artificial Sequence:  synthetic
uaguuaaugagccaucacu

SEQ ID NO: 312 - RNA, 19 nt, Artificial Sequence
  Description of Artificial Sequence:  synthetic
uagaagaaaagcccauuuu

SEQ ID NO: 313 - RNA, 19 nt, Artificial Sequence
  Description of Artificial Sequence:  synthetic
ucaacugcuuugaaacuug

SEQ ID NO: 314 - RNA, 19 nt, Artificial Sequence
  Description of Artificial Sequence:  synthetic
gccuggggucugagcauga

SEQ ID NO: 315 - RNA, 19 nt, Artificial Sequence
  Description of Artificial Sequence:  synthetic
augggaauagggagacagg

SEQ ID NO: 316 - RNA, 19 nt, Artificial Sequence
  Description of Artificial Sequence:  synthetic
gguaggaaagggcgccuac

SEQ ID NO: 317 - RNA, 19 nt, Artificial Sequence
  Description of Artificial Sequence:  synthetic
cucuucagggucuaaagau

SEQ ID NO: 318 - RNA, 19 nt, Artificial Sequence
  Description of Artificial Sequence:  synthetic
ucaagugggccuuggaucg

SEQ ID NO: 319 - RNA, 19 nt, Artificial Sequence
  Description of Artificial Sequence:  synthetic
gcuaagcuggcucuguuug

SEQ ID NO: 320 - RNA, 19 nt, Artificial Sequence
  Description of Artificial Sequence:  synthetic
gaugcuauuuaugcaaguu

SEQ ID NO: 321 - RNA, 19 nt, Artificial Sequence
  Description of Artificial Sequence:  synthetic
uagggucuauguauuuagg

SEQ ID NO: 322 - RNA, 19 nt, Artificial Sequence
  Description of Artificial Sequence:  synthetic
gaugcgccuacucuucagg

SEQ ID NO: 323 - RNA, 19 nt, Artificial Sequence
  Description of Artificial Sequence:  synthetic
ggucuaaagaucaaguggg

SEQ ID NO: 324 - RNA, 19 nt, Artificial Sequence
  Description of Artificial Sequence:  synthetic
gccuuggaucgcuaagcug

SEQ ID NO: 325 - RNA, 19 nt, Artificial Sequence
  Description of Artificial Sequence:  synthetic
ggcucuguuugaugcuauu

SEQ ID NO: 326 - RNA, 19 nt, Artificial Sequence
  Description of Artificial Sequence:  synthetic
uuaugcaaguuagggucua

SEQ ID NO: 327 - RNA, 19 nt, Artificial Sequence
  Description of Artificial Sequence:  synthetic
auguauuuaggaugucugc

SEQ ID NO: 328 - RNA, 19 nt, Artificial Sequence
  Description of Artificial Sequence:  synthetic
caccuucugcagccaguca

SEQ ID NO: 329 - RNA, 19 nt, Artificial Sequence
  Description of Artificial Sequence:  synthetic
agaagcuggagaggcaaca

SEQ ID NO: 330 - RNA, 19 nt, Artificial Sequence
  Description of Artificial Sequence:  synthetic
aguggauugcugcuucuug

SEQ ID NO: 331 - RNA, 19 nt, Artificial Sequence
  Description of Artificial Sequence:  synthetic
ggggagaagaguaugcuuc

SEQ ID NO: 332 - RNA, 19 nt, Artificial Sequence
  Description of Artificial Sequence:  synthetic
ccuuuuauccauguaauuu

SEQ ID NO: 333 - RNA, 19 nt, Artificial Sequence
  Description of Artificial Sequence:  synthetic
uaacuguagaaccugagcu

SEQ ID NO: 334 - RNA, 19 nt, Artificial Sequence
  Description of Artificial Sequence:  synthetic
ucuaaguaaccgaagaaug

SEQ ID NO: 335 - RNA, 19 nt, Artificial Sequence
  Description of Artificial Sequence:  synthetic
guaugccucuguucuuaug

SEQ ID NO: 336 - RNA, 19 nt, Artificial Sequence
  Description of Artificial Sequence:  synthetic
gugccacauccuuguuuaa

SEQ ID NO: 337 - RNA, 19 nt, Artificial Sequence
  Description of Artificial Sequence:  synthetic
aaggcucucuguaugaaga

SEQ ID NO: 338 - RNA, 19 nt, Artificial Sequence
  Description of Artificial Sequence:  synthetic
agaugggaccgucaucagc

SEQ ID NO: 339 - RNA, 19 nt, Artificial Sequence
  Description of Artificial Sequence:  synthetic
cacauucccuagugagccu

SEQ ID NO: 340 - RNA, 19 nt, Artificial Sequence
  Description of Artificial Sequence:  synthetic
uacuggcuccuggcagcgg

SEQ ID NO: 341 - RNA, 19 nt, Artificial Sequence
  Description of Artificial Sequence:  synthetic
gcuuuuguggaagacucac

SEQ ID NO: 342 - RNA, 19 nt, Artificial Sequence
  Description of Artificial Sequence:  synthetic
cuagccagaagagaggagu

SEQ ID NO: 343 - RNA, 19 nt, Artificial Sequence
  Description of Artificial Sequence:  synthetic
ugggacaguccucuccacc

SEQ ID NO: 344 - RNA, 19 nt, Artificial Sequence
  Description of Artificial Sequence:  synthetic
caagaucuaaauccaaaca

SEQ ID NO: 345 - RNA, 19 nt, Artificial Sequence
  Description of Artificial Sequence:  synthetic
aaaagcaggcuagagccag

SEQ ID NO: 346 - RNA, 19 nt, Artificial Sequence
  Description of Artificial Sequence:  synthetic
gaagagaggacaaaucuuu

SEQ ID NO: 347 - RNA, 19 nt, Artificial Sequence
  Description of Artificial Sequence:  synthetic
uguuguuccucuucuuuac

SEQ ID NO: 348 - RNA, 19 nt, Artificial Sequence
  Description of Artificial Sequence:  synthetic
cacauacgcaaaccaccug

SEQ ID NO: 349 - RNA, 19 nt, Artificial Sequence
  Description of Artificial Sequence:  synthetic
gugacagcuggcaauuuua

SEQ ID NO: 350 - RNA, 19 nt, Artificial Sequence
  Description of Artificial Sequence:  synthetic
auaaaucagguaacuggaa

SEQ ID NO: 351 - RNA, 19 nt, Artificial Sequence
  Description of Artificial Sequence:  synthetic
aggagguuaaacucagaaa

SEQ ID NO: 352 - RNA, 19 nt, Artificial Sequence
  Description of Artificial Sequence:  synthetic
aaaagaagaccucagucaa

SEQ ID NO: 353 - RNA, 19 nt, Artificial Sequence
  Description of Artificial Sequence:  synthetic
auucucuacuuuuuuuuuu

SEQ ID NO: 354 - RNA, 19 nt, Artificial Sequence
  Description of Artificial Sequence:  synthetic
uuuuuuuccaaaucagaua

SEQ ID NO: 355 - RNA, 19 nt, Artificial Sequence
  Description of Artificial Sequence:  synthetic
aauagcccagcaaauagug

SEQ ID NO: 356 - RNA, 19 nt, Artificial Sequence
  Description of Artificial Sequence:  synthetic
gauaacaaauaaaaccuua

SEQ ID NO: 357 - RNA, 19 nt, Artificial Sequence
  Description of Artificial Sequence:  synthetic
agcuguucaugucuugauu

SEQ ID NO: 358 - RNA, 19 nt, Artificial Sequence
  Description of Artificial Sequence:  synthetic
uucaauaauuaauucuuaa

SEQ ID NO: 359 - RNA, 19 nt, Artificial Sequence
  Description of Artificial Sequence:  synthetic
aucauuaagagaccauaau

SEQ ID NO: 360 - RNA, 19 nt, Artificial Sequence
  Description of Artificial Sequence:  synthetic
uaaauacuccuuuucaaga

SEQ ID NO: 361 - RNA, 19 nt, Artificial Sequence
  Description of Artificial Sequence:  synthetic
agaaaagcaaaaccauuag

SEQ ID NO: 362 - RNA, 19 nt, Artificial Sequence
  Description of Artificial Sequence:  synthetic
gaauuguuacucagcuccu

SEQ ID NO: 363 - RNA, 19 nt, Artificial Sequence
  Description of Artificial Sequence:  synthetic
uucaaacucagguuuguag

SEQ ID NO: 364 - RNA, 19 nt, Artificial Sequence
  Description of Artificial Sequence:  synthetic
gcauacaugaguccaucca

SEQ ID NO: 365 - RNA, 19 nt, Artificial Sequence
  Description of Artificial Sequence:  synthetic
aucagucaaagaaugguuc

SEQ ID NO: 366 - RNA, 19 nt, Artificial Sequence
  Description of Artificial Sequence:  synthetic
ccaucuggagucuuaaugu

SEQ ID NO: 367 - RNA, 19 nt, Artificial Sequence
  Description of Artificial Sequence:  synthetic
uagaaagaaaaauggagac

SEQ ID NO: 368 - RNA, 19 nt, Artificial Sequence
  Description of Artificial Sequence:  synthetic
cuuguaauaaugagcuagu

SEQ ID NO: 369 - RNA, 19 nt, Artificial Sequence
  Description of Artificial Sequence:  synthetic
uuacaaagugcuuguucau

SEQ ID NO: 370 - RNA, 19 nt, Artificial Sequence
  Description of Artificial Sequence:  synthetic
uuaaaauagcacugaaaau

SEQ ID NO: 371 - RNA, 19 nt, Artificial Sequence
  Description of Artificial Sequence:  synthetic
uugaaacaugaauuaacug

SEQ ID NO: 372 - RNA, 19 nt, Artificial Sequence
  Description of Artificial Sequence:  synthetic
gauaauauuccaaucauuu

SEQ ID NO: 373 - RNA, 19 nt, Artificial Sequence
  Description of Artificial Sequence:  synthetic
ugccauuuaugacaaaaau

SEQ ID NO: 374 - RNA, 19 nt, Artificial Sequence
  Description of Artificial Sequence:  synthetic
ugguuggcacuaacaaaga

SEQ ID NO: 375 - RNA, 19 nt, Artificial Sequence
  Description of Artificial Sequence:  synthetic
aacgagcacuuccuuucag

SEQ ID NO: 376 - RNA, 19 nt, Artificial Sequence
  Description of Artificial Sequence:  synthetic
gaguuucugagauaaugua

SEQ ID NO: 377 - RNA, 19 nt, Artificial Sequence
  Description of Artificial Sequence:  synthetic
acguggaacagucugggug

SEQ ID NO: 378 - RNA, 19 nt, Artificial Sequence
  Description of Artificial Sequence:  synthetic
ggaauggggcugaaaccau

SEQ ID NO: 379 - RNA, 19 nt, Artificial Sequence
  Description of Artificial Sequence:  synthetic
ugugcaagucugugucuug

SEQ ID NO: 380 - RNA, 19 nt, Artificial Sequence
  Description of Artificial Sequence:  synthetic
gucaguccaagaagugaca

SEQ ID NO: 381 - RNA, 19 nt, Artificial Sequence
  Description of Artificial Sequence:  synthetic
accgagauguuaauuuuag

SEQ ID NO: 382 - RNA, 19 nt, Artificial Sequence
  Description of Artificial Sequence:  synthetic
gggacccgugccuuguuuc

SEQ ID NO: 383 - RNA, 19 nt, Artificial Sequence
  Description of Artificial Sequence:  synthetic
ccuagcccacaagaaugca

SEQ ID NO: 384 - RNA, 19 nt, Artificial Sequence
  Description of Artificial Sequence:  synthetic
aaacaucaaacagauacuc

SEQ ID NO: 385 - RNA, 19 nt, Artificial Sequence
  Description of Artificial Sequence:  synthetic
cgcuagccucauuuaaauu

SEQ ID NO: 386 - RNA, 19 nt, Artificial Sequence
  Description of Artificial Sequence:  synthetic
ugauuaaaggaggagugca

SEQ ID NO: 387 - RNA, 19 nt, Artificial Sequence
  Description of Artificial Sequence:  synthetic
aucuuuggccgacaguggu

SEQ ID NO: 388 - RNA, 19 nt, Artificial Sequence
  Description of Artificial Sequence:  synthetic
uguaacugugugugugugu

SEQ ID NO: 389 - RNA, 19 nt, Artificial Sequence
  Description of Artificial Sequence:  synthetic
ugugugugugugugugugu

SEQ ID NO: 390 - RNA, 19 nt, Artificial Sequence
  Description of Artificial Sequence:  synthetic
ugugugugugugggugugg

SEQ ID NO: 391 - RNA, 19 nt, Artificial Sequence
  Description of Artificial Sequence:  synthetic
gguguauguguguuuugug

SEQ ID NO: 392 - RNA, 19 nt, Artificial Sequence
  Description of Artificial Sequence:  synthetic
gcauaacuauuuaaggaaa

SEQ ID NO: 393 - RNA, 19 nt, Artificial Sequence
  Description of Artificial Sequence:  synthetic
acuggaauuuuaaaguuac

SEQ ID NO: 394 - RNA, 19 nt, Artificial Sequence
  Description of Artificial Sequence:  synthetic
cuuuuauacaaaccaagaa

SEQ ID NO: 395 - RNA, 19 nt, Artificial Sequence
  Description of Artificial Sequence:  synthetic
auauaugcuacagauauaa

SEQ ID NO: 396 - RNA, 19 nt, Artificial Sequence
  Description of Artificial Sequence:  synthetic
agacagacaugguuugguc

SEQ ID NO: 397 - RNA, 19 nt, Artificial Sequence
  Description of Artificial Sequence:  synthetic
ccuauauuucuagucauga

SEQ ID NO: 398 - RNA, 19 nt, Artificial Sequence
  Description of Artificial Sequence:  synthetic
augaauguauuuuguauac

SEQ ID NO: 399 - RNA, 19 nt, Artificial Sequence
  Description of Artificial Sequence:  synthetic
ccaucuucauauaauauac

SEQ ID NO: 400 - RNA, 19 nt, Artificial Sequence
  Description of Artificial Sequence:  synthetic
cuuaaaaauauuucuuaau

SEQ ID NO: 401 - RNA, 19 nt, Artificial Sequence
  Description of Artificial Sequence:  synthetic
uugggauuuguaaucguac

SEQ ID NO: 402 - RNA, 19 nt, Artificial Sequence
  Description of Artificial Sequence:  synthetic
ccaacuuaauugauaaacu

SEQ ID NO: 403 - RNA, 19 nt, Artificial Sequence
  Description of Artificial Sequence:  synthetic
uuggcaacugcuuuuaugu

SEQ ID NO: 404 - RNA, 19 nt, Artificial Sequence
  Description of Artificial Sequence:  synthetic
uucugucuccuuccauaaa

SEQ ID NO: 405 - RNA, 19 nt, Artificial Sequence
  Description of Artificial Sequence:  synthetic
auuuuucaaaauacuaauu

SEQ ID NO: 406 - RNA, 19 nt, Artificial Sequence
  Description of Artificial Sequence:  synthetic
ucaacaaagaaaaagcucu

SEQ ID NO: 407 - RNA, 19 nt, Artificial Sequence
  Description of Artificial Sequence:  synthetic
uuuuuuuuccuaaaauaaa

SEQ ID NO: 408 - RNA, 19 nt, Artificial Sequence
  Description of Artificial Sequence:  synthetic
acucaaauuuauccuuguu

SEQ ID NO: 409 - RNA, 19 nt, Artificial Sequence
  Description of Artificial Sequence:  synthetic
uuagagcagagaaaaauua

SEQ ID NO: 410 - RNA, 19 nt, Artificial Sequence
  Description of Artificial Sequence:  synthetic
aagaaaaacuuugaaaugg

SEQ ID NO: 411 - RNA, 19 nt, Artificial Sequence
  Description of Artificial Sequence:  synthetic
gucucaaaaaauugcuaaa

SEQ ID NO: 412 - RNA, 19 nt, Artificial Sequence
  Description of Artificial Sequence:  synthetic
auauuuucaauggaaaacu

SEQ ID NO: 413 - RNA, 19 nt, Artificial Sequence
  Description of Artificial Sequence:  synthetic
uaaauguuaguuuagcuga

SEQ ID NO: 414 - RNA, 19 nt, Artificial Sequence
  Description of Artificial Sequence:  synthetic
auuguaugggguuuucgaa

SEQ ID NO: 415 - RNA, 19 nt, Artificial Sequence
  Description of Artificial Sequence:  synthetic
accuuucacuuuuuguuug

SEQ ID NO: 416 - RNA, 19 nt, Artificial Sequence
  Description of Artificial Sequence:  synthetic
guuuuaccuauuucacaac

SEQ ID NO: 417 - RNA, 19 nt, Artificial Sequence
  Description of Artificial Sequence:  synthetic
cuguguaaauugccaauaa

SEQ ID NO: 418 - RNA, 19 nt, Artificial Sequence
  Description of Artificial Sequence:  synthetic
auuccuguccaugaaaaug

SEQ ID NO: 419 - RNA, 19 nt, Artificial Sequence
  Description of Artificial Sequence:  synthetic
gcaaauuauccaguguaga

SEQ ID NO: 420 - RNA, 19 nt, Artificial Sequence
  Description of Artificial Sequence:  synthetic
auauauuugaccaucaccc

SEQ ID NO: 421 - RNA, 19 nt, Artificial Sequence
  Description of Artificial Sequence:  synthetic
cuauggauauuggcuaguu

SEQ ID NO: 422 - RNA, 19 nt, Artificial Sequence
  Description of Artificial Sequence:  synthetic
uuugccuuuauuaagcaaa

SEQ ID NO: 423 - RNA, 19 nt, Artificial Sequence
  Description of Artificial Sequence:  synthetic
auucauuucagccugaaug

SEQ ID NO: 424 - RNA, 19 nt, Artificial Sequence
  Description of Artificial Sequence:  synthetic
gucugccuauauauucucu

SEQ ID NO: 425 - RNA, 19 nt, Artificial Sequence
  Description of Artificial Sequence:  synthetic
ugcucuuuguauucuccuu

SEQ ID NO: 426 - RNA, 19 nt, Artificial Sequence
  Description of Artificial Sequence:  synthetic
uugaacccguuaaaacauc

SEQ ID NO: 427 - RNA, 19 nt, Artificial Sequence
  Description of Artificial Sequence:  synthetic
aaaacauccuguggcacuc

SEQ ID NO: 428 - RNA, 19 nt, Artificial Sequence
  Description of Artificial Sequence:  synthetic
agccgagaggaguguccgc

SEQ ID NO: 429 - RNA, 19 nt, Artificial Sequence
  Description of Artificial Sequence:  synthetic
ccgccgcugccggggagga

SEQ ID NO: 430 - RNA, 19 nt, Artificial Sequence
  Description of Artificial Sequence:  synthetic
ggagcccgcuccgagccgc

SEQ ID NO: 431 - RNA, 19 nt, Artificial Sequence
  Description of Artificial Sequence:  synthetic
ccgcugcacccgagccccg

SEQ ID NO: 432 - RNA, 19 nt, Artificial Sequence
  Description of Artificial Sequence:  synthetic
cgccgccaggcccgcuggc

SEQ ID NO: 433 - RNA, 19 nt, Artificial Sequence
  Description of Artificial Sequence:  synthetic
acuuccccggguaauccuc

SEQ ID NO: 434 - RNA, 19 nt, Artificial Sequence
  Description of Artificial Sequence:  synthetic
uccagccaggagacaacca

SEQ ID NO: 435 - RNA, 19 nt, Artificial Sequence
  Description of Artificial Sequence:  synthetic
gagcgcccgucucgcggcu

SEQ ID NO: 436 - RNA, 19 nt, Artificial Sequence
  Description of Artificial Sequence:  synthetic
ccgccggccccgcgcccug

SEQ ID NO: 437 - RNA, 19 nt, Artificial Sequence
  Description of Artificial Sequence:  synthetic
ccguccucucguucgccgc

SEQ ID NO: 438 - RNA, 19 nt, Artificial Sequence
  Description of Artificial Sequence:  synthetic
cgacccggccgccagaguc

SEQ ID NO: 439 - RNA, 19 nt, Artificial Sequence
  Description of Artificial Sequence:  synthetic
ccgcgcucccccggccaac

SEQ ID NO: 440 - RNA, 19 nt, Artificial Sequence
  Description of Artificial Sequence:  synthetic
ggccugcucgcccggugcc

SEQ ID NO: 441 - RNA, 19 nt, Artificial Sequence
  Description of Artificial Sequence:  synthetic
ccauggugagcgcgacgcg

SEQ ID NO: 442 - RNA, 19 nt, Artificial Sequence
  Description of Artificial Sequence:  synthetic
cggugucccaguagcugac

SEQ ID NO: 443 - RNA, 19 nt, Artificial Sequence
  Description of Artificial Sequence:  synthetic
gcgcgcacagcaggacccc

SEQ ID NO: 444 - RNA, 19 nt, Artificial Sequence
  Description of Artificial Sequence:  synthetic
gaagcagacagcugagcag

SEQ ID NO: 445 - RNA, 19 nt, Artificial Sequence
  Description of Artificial Sequence:  synthetic
cugaacuagauccugugag

SEQ ID NO: 446 - RNA, 19 nt, Artificial Sequence
  Description of Artificial Sequence:  synthetic
gaucuuuuaauuuugaacc

SEQ ID NO: 447 - RNA, 19 nt, Artificial Sequence
  Description of Artificial Sequence:  synthetic
cuuuuaaacucaguucagg

SEQ ID NO: 448 - RNA, 19 nt, Artificial Sequence
  Description of Artificial Sequence:  synthetic
gcaugaugugcugggugcc

SEQ ID NO: 449 - RNA, 19 nt, Artificial Sequence
  Description of Artificial Sequence:  synthetic
gcagugucuggccugcuug

SEQ ID NO: 450 - RNA, 19 nt, Artificial Sequence
  Description of Artificial Sequence:  synthetic
ccccccugcauuggagaug

SEQ ID NO: 451 - RNA, 19 nt, Artificial Sequence
  Description of Artificial Sequence:  synthetic
accauuuaugggcugcuuc

SEQ ID NO: 452 - RNA, 19 nt, Artificial Sequence
  Description of Artificial Sequence:  synthetic
ucaccauuucaggcaaaga

SEQ ID NO: 453 - RNA, 19 nt, Artificial Sequence
  Description of Artificial Sequence:  synthetic
gccuuucgcuuuccuuacu

SEQ ID NO: 454 - RNA, 19 nt, Artificial Sequence
  Description of Artificial Sequence:  synthetic
cagauuuaguuaugcucag

SEQ ID NO: 455 - RNA, 19 nt, Artificial Sequence
  Description of Artificial Sequence:  synthetic
ugccauuucuuccacaggc

SEQ ID NO: 456 - RNA, 19 nt, Artificial Sequence
  Description of Artificial Sequence:  synthetic
aaguacugcagaauuguuu

SEQ ID NO: 457 - RNA, 19 nt, Artificial Sequence
  Description of Artificial Sequence:  synthetic
gagcuguguucaagguuaa

SEQ ID NO: 458 - RNA, 19 nt, Artificial Sequence
  Description of Artificial Sequence:  synthetic
agccagugugguuugcuug

SEQ ID NO: 459 - RNA, 19 nt, Artificial Sequence
  Description of Artificial Sequence:  synthetic
gauauuugcagcuguagaa

SEQ ID NO: 460 - RNA, 19 nt, Artificial Sequence
  Description of Artificial Sequence:  synthetic
uugaaguagguacagcuag

SEQ ID NO: 461 - RNA, 19 nt, Artificial Sequence
  Description of Artificial Sequence:  synthetic
auucuguuuccuucuucuu

SEQ ID NO: 462 - RNA, 19 nt, Artificial Sequence
  Description of Artificial Sequence:  synthetic
uaaauauauagauugcaga

SEQ ID NO: 463 - RNA, 19 nt, Artificial Sequence
  Description of Artificial Sequence:  synthetic
gucuaccuguaucacuaau

SEQ ID NO: 464 - RNA, 19 nt, Artificial Sequence
  Description of Artificial Sequence:  synthetic
uguacaucucuacgaaagg

SEQ ID NO: 465 - RNA, 19 nt, Artificial Sequence
  Description of Artificial Sequence:  synthetic
uaauuucggggauuucacu

SEQ ID NO: 466 - RNA, 19 nt, Artificial Sequence
  Description of Artificial Sequence:  synthetic
uuccuucagucauguguau

SEQ ID NO: 467 - RNA, 19 nt, Artificial Sequence
  Description of Artificial Sequence:  synthetic
agggaaugacgagcucccu

SEQ ID NO: 468 - RNA, 19 nt, Artificial Sequence
  Description of Artificial Sequence:  synthetic
uaggugacguaacccggca

SEQ ID NO: 469 - RNA, 19 nt, Artificial Sequence
  Description of Artificial Sequence:  synthetic
uuaaaguaacagugauguu

SEQ ID NO: 470 - RNA, 19 nt, Artificial Sequence
  Description of Artificial Sequence:  synthetic
ugucaaguggaaacuuuuu

SEQ ID NO: 471 - RNA, 19 nt, Artificial Sequence
  Description of Artificial Sequence:  synthetic
uuccaucagggaucaaagu

SEQ ID NO: 472 - RNA, 19 nt, Artificial Sequence
  Description of Artificial Sequence:  synthetic
ugucccagauuaugcguuu

SEQ ID NO: 473 - RNA, 19 nt, Artificial Sequence
  Description of Artificial Sequence:  synthetic
ugaugaagcccuuucuacu

SEQ ID NO: 474 - RNA, 19 nt, Artificial Sequence
  Description of Artificial Sequence:  synthetic
uguacguugcauuugauau

SEQ ID NO: 475 - RNA, 19 nt, Artificial Sequence
  Description of Artificial Sequence:  synthetic
ucagaagcccuauuucuuu

SEQ ID NO: 476 - RNA, 19 nt, Artificial Sequence
  Description of Artificial Sequence:  synthetic
ugacuguugcuucacaggu

SEQ ID NO: 477 - RNA, 19 nt, Artificial Sequence
  Description of Artificial Sequence:  synthetic
ucuuauacaaaugcccauu

SEQ ID NO: 478 - RNA, 19 nt, Artificial Sequence
  Description of Artificial Sequence:  synthetic
gaugugugagauaguuugu

SEQ ID NO: 479 - RNA, 19 nt, Artificial Sequence
  Description of Artificial Sequence:  synthetic
ugauuguauugguuugucg

SEQ ID NO: 480 - RNA, 19 nt, Artificial Sequence
  Description of Artificial Sequence:  synthetic
ugcuuauuuggacaucuau

SEQ ID NO: 481 - RNA, 19 nt, Artificial Sequence
  Description of Artificial Sequence:  synthetic
auuugacugggcguggugu

SEQ ID NO: 482 - RNA, 19 nt, Artificial Sequence
  Description of Artificial Sequence:  synthetic
gaguauggccucuaaguaa

SEQ ID NO: 483 - RNA, 19 nt, Artificial Sequence
  Description of Artificial Sequence:  synthetic
caguacaauugaggacaag

SEQ ID NO: 484 - RNA, 19 nt, Artificial Sequence
  Description of Artificial Sequence:  synthetic
uguucaagggagugguagc

SEQ ID NO: 485 - RNA, 19 nt, Artificial Sequence
  Description of Artificial Sequence:  synthetic
aggucauuugaacucucgu

SEQ ID NO: 486 - RNA, 19 nt, Artificial Sequence
  Description of Artificial Sequence:  synthetic
uuucaucaggguaacucca

SEQ ID NO: 487 - RNA, 19 nt, Artificial Sequence
  Description of Artificial Sequence:  synthetic
cggaagcucucuuauuuuu

SEQ ID NO: 488 - RNA, 19 nt, Artificial Sequence
  Description of Artificial Sequence:  synthetic
ggucaauucgucgccuuac

SEQ ID NO: 489 - RNA, 19 nt, Artificial Sequence
  Description of Artificial Sequence:  synthetic
uggcaugggaauugcuuug

SEQ ID NO: 490 - RNA, 19 nt, Artificial Sequence
  Description of Artificial Sequence:  synthetic
gaacacuguagaauauguu

SEQ ID NO: 491 - RNA, 19 nt, Artificial Sequence
  Description of Artificial Sequence:  synthetic
gcauuuugucaauaguaag

SEQ ID NO: 492 - RNA, 19 nt, Artificial Sequence
  Description of Artificial Sequence:  synthetic
guccuuugucuuuguucug

SEQ ID NO: 493 - RNA, 19 nt, Artificial Sequence
  Description of Artificial Sequence:  synthetic
uuacacgacaaguauaaag

SEQ ID NO: 494 - RNA, 19 nt, Artificial Sequence
  Description of Artificial Sequence:  synthetic
ugaaugaugguccacuccu

SEQ ID NO: 495 - RNA, 19 nt, Artificial Sequence
  Description of Artificial Sequence:  synthetic
cugagguguuaacagauuu

SEQ ID NO: 496 - RNA, 19 nt, Artificial Sequence
  Description of Artificial Sequence:  synthetic
cuuuaucauauauaugcac

SEQ ID NO: 497 - RNA, 19 nt, Artificial Sequence
  Description of Artificial Sequence:  synthetic
guuucacagugaugaaugc

SEQ ID NO: 498 - RNA, 19 nt, Artificial Sequence
  Description of Artificial Sequence:  synthetic
gcaccugcuguuuucgaug

SEQ ID NO: 499 - RNA, 19 nt, Artificial Sequence
  Description of Artificial Sequence:  synthetic
ugccagcuacgguuucaag

SEQ ID NO: 500 - RNA, 19 nt, Artificial Sequence
  Description of Artificial Sequence:  synthetic
agagccgguaagaccgcuu

SEQ ID NO: 501 - RNA, 19 nt, Artificial Sequence
  Description of Artificial Sequence:  synthetic
augccuucacuuucauaga

SEQ ID NO: 502 - RNA, 19 nt, Artificial Sequence
  Description of Artificial Sequence:  synthetic
caacuuccggcgagggaaa

SEQ ID NO: 503 - RNA, 19 nt, Artificial Sequence
  Description of Artificial Sequence:  synthetic
acccaucuuuuaaccauac

SEQ ID NO: 504 - RNA, 19 nt, Artificial Sequence
  Description of Artificial Sequence:  synthetic
auuucucagucgcagguaa

SEQ ID NO: 505 - RNA, 19 nt, Artificial Sequence
  Description of Artificial Sequence:  synthetic
gagucaaauagcgagcaga

SEQ ID NO: 506 - RNA, 19 nt, Artificial Sequence
  Description of Artificial Sequence:  synthetic
uaauuaacgaguagccacg

SEQ ID NO: 507 - RNA, 19 nt, Artificial Sequence
  Description of Artificial Sequence:  synthetic
cuucaguuacguccuugau

SEQ ID NO: 508 - RNA, 19 nt, Artificial Sequence
  Description of Artificial Sequence:  synthetic
uauaauucccugcauccuc

SEQ ID NO: 509 - RNA, 19 nt, Artificial Sequence
  Description of Artificial Sequence:  synthetic
uuaugcucagcaagauugu

SEQ ID NO: 510 - RNA, 19 nt, Artificial Sequence
  Description of Artificial Sequence:  synthetic
uaaacacauuugacuguuu

SEQ ID NO: 511 - RNA, 19 nt, Artificial Sequence
  Description of Artificial Sequence:  synthetic
gaguggcagugagguuuuu

SEQ ID NO: 512 - RNA, 19 nt, Artificial Sequence
  Description of Artificial Sequence:  synthetic
guuucacauugacaauuag

SEQ ID NO: 513 - RNA, 19 nt, Artificial Sequence
  Description of Artificial Sequence:  synthetic
ccuuuucguaaaucugggg

SEQ ID NO: 514 - RNA, 19 nt, Artificial Sequence
  Description of Artificial Sequence:  synthetic
cuggaaacgaugacacggc

SEQ ID NO: 515 - RNA, 19 nt, Artificial Sequence
  Description of Artificial Sequence:  synthetic
guggguagagagccggguc

SEQ ID NO: 516 - RNA, 19 nt, Artificial Sequence
  Description of Artificial Sequence:  synthetic
ggauuugucugcugcccag

SEQ ID NO: 517 - RNA, 19 nt, Artificial Sequence
  Description of Artificial Sequence:  synthetic
cauaugcgguacaagucag

SEQ ID NO: 518 - RNA, 19 nt, Artificial Sequence
  Description of Artificial Sequence:  synthetic
uuguagguugagggauacc

SEQ ID NO: 519 - RNA, 19 nt, Artificial Sequence
  Description of Artificial Sequence:  synthetic
ggugccagaaccacuugau

SEQ ID NO: 520 - RNA, 19 nt, Artificial Sequence
  Description of Artificial Sequence:  synthetic
aaugauuaugguuacaggg

SEQ ID NO: 521 - RNA, 19 nt, Artificial Sequence
  Description of Artificial Sequence:  synthetic
agucacaccuugcuucgga

SEQ ID NO: 522 - RNA, 19 nt, Artificial Sequence
  Description of Artificial Sequence:  synthetic
cuucauuauuggaacaaaa

SEQ ID NO: 523 - RNA, 19 nt, Artificial Sequence
  Description of Artificial Sequence:  synthetic
cauccaggauaaaggacuc

SEQ ID NO: 524 - RNA, 19 nt, Artificial Sequence
  Description of Artificial Sequence:  synthetic
uucccauguugcugucagc

SEQ ID NO: 525 - RNA, 19 nt, Artificial Sequence
  Description of Artificial Sequence:  synthetic
ugaugcucucaauucuguu

SEQ ID NO: 526 - RNA, 19 nt, Artificial Sequence
  Description of Artificial Sequence:  synthetic
uuauugccaugcgcugagu

SEQ ID NO: 527 - RNA, 19 nt, Artificial Sequence
  Description of Artificial Sequence:  synthetic
ucuuauucuuuccuucuau

SEQ ID NO: 528 - RNA, 19 nt, Artificial Sequence
  Description of Artificial Sequence:  synthetic
caaccaaggugcuagccau

SEQ ID NO: 529 - RNA, 19 nt, Artificial Sequence
  Description of Artificial Sequence:  synthetic
aaauucuagagucagccac

SEQ ID NO: 530 - RNA, 19 nt, Artificial Sequence
  Description of Artificial Sequence:  synthetic
ugcaaauguagauuccaga

SEQ ID NO: 531 - RNA, 19 nt, Artificial Sequence
  Description of Artificial Sequence:  synthetic
caacuuuauuggaagcuau

SEQ ID NO: 532 - RNA, 19 nt, Artificial Sequence
  Description of Artificial Sequence:  synthetic
uguuucuucccacaguccc

SEQ ID NO: 533 - RNA, 19 nt, Artificial Sequence
  Description of Artificial Sequence:  synthetic
cugugauauaaaagcuuau

SEQ ID NO: 534 - RNA, 19 nt, Artificial Sequence
  Description of Artificial Sequence:  synthetic
gaaacccauuuggcacauc

SEQ ID NO: 535 - RNA, 19 nt, Artificial Sequence
  Description of Artificial Sequence:  synthetic
uuuuuuccaaguuaacaug

SEQ ID NO: 536 - RNA, 19 nt, Artificial Sequence
  Description of Artificial Sequence:  synthetic
ccucuccuuccgucggcau

SEQ ID NO: 537 - RNA, 19 nt, Artificial Sequence
  Description of Artificial Sequence:  synthetic
ugcaagacaguuucagguc

SEQ ID NO: 538 - RNA, 19 nt, Artificial Sequence
  Description of Artificial Sequence:  synthetic
auaagaacuuguuaacugu

SEQ ID NO: 539 - RNA, 19 nt, Artificial Sequence
  Description of Artificial Sequence:  synthetic
uccaaguaacgucucugua

SEQ ID NO: 540 - RNA, 19 nt, Artificial Sequence
  Description of Artificial Sequence:  synthetic
uaacuguccgcaguaaaau

SEQ ID NO: 541 - RNA, 19 nt, Artificial Sequence
  Description of Artificial Sequence:  synthetic
agugcauuguucuguuauu

SEQ ID NO: 542 - RNA, 19 nt, Artificial Sequence
  Description of Artificial Sequence:  synthetic
uuugcuugcuaauacugua

SEQ ID NO: 543 - RNA, 19 nt, Artificial Sequence
  Description of Artificial Sequence:  synthetic
ccuuagugauggccauuuu

SEQ ID NO: 544 - RNA, 19 nt, Artificial Sequence
  Description of Artificial Sequence:  synthetic
uaagagugauggagugcuc

SEQ ID NO: 545 - RNA, 19 nt, Artificial Sequence
  Description of Artificial Sequence:  synthetic
cauucaugaugguaagauu

SEQ ID NO: 546 - RNA, 19 nt, Artificial Sequence
  Description of Artificial Sequence:  synthetic
cugaaucuugcagggaaac

SEQ ID NO: 547 - RNA, 19 nt, Artificial Sequence
  Description of Artificial Sequence:  synthetic
cucugcaggcauaggugcc

SEQ ID NO: 548 - RNA, 19 nt, Artificial Sequence
  Description of Artificial Sequence:  synthetic
cuguguauacauuccuggc

SEQ ID NO: 549 - RNA, 19 nt, Artificial Sequence
  Description of Artificial Sequence:  synthetic
ucuggaggauuucuucccc

SEQ ID NO: 550 - RNA, 19 nt, Artificial Sequence
  Description of Artificial Sequence:  synthetic
ugauuguaauuucuuucuu

SEQ ID NO: 551 - RNA, 19 nt, Artificial Sequence
  Description of Artificial Sequence:  synthetic
auggugcuuccugaucucu

SEQ ID NO: 552 - RNA, 19 nt, Artificial Sequence
  Description of Artificial Sequence:  synthetic
ugagguuucgcaggaggua

SEQ ID NO: 553 - RNA, 19 nt, Artificial Sequence
  Description of Artificial Sequence:  synthetic
uggccacugugugaucacu

SEQ ID NO: 554 - RNA, 19 nt, Artificial Sequence
  Description of Artificial Sequence:  synthetic
aagugguggaacugcugau

SEQ ID NO: 555 - RNA, 19 nt, Artificial Sequence
  Description of Artificial Sequence:  synthetic
cauuagcaugacagucuaa

SEQ ID NO: 556 - RNA, 19 nt, Artificial Sequence
  Description of Artificial Sequence:  synthetic
ucugaggcucggggacacc

SEQ ID NO: 557 - RNA, 19 nt, Artificial Sequence
  Description of Artificial Sequence:  synthetic
uguuuuuaaaccaagugau

SEQ ID NO: 558 - RNA, 19 nt, Artificial Sequence
  Description of Artificial Sequence:  synthetic
cuuguuguauuuugugguu

SEQ ID NO: 559 - RNA, 19 nt, Artificial Sequence
  Description of Artificial Sequence:  synthetic
cuaaaauaauuccaggcuc

SEQ ID NO: 560 - RNA, 19 nt, Artificial Sequence
  Description of Artificial Sequence:  synthetic
gcgugcugcuuccuggucc

SEQ ID NO: 561 - RNA, 19 nt, Artificial Sequence
  Description of Artificial Sequence:  synthetic
ugacucuuucaauaaacag

SEQ ID NO: 562 - RNA, 19 nt, Artificial Sequence
  Description of Artificial Sequence:  synthetic
caccuucauccucuucugu

SEQ ID NO: 563 - RNA, 19 nt, Artificial Sequence
  Description of Artificial Sequence:  synthetic
uggcuuugcagugauagac

SEQ ID NO: 564 - RNA, 19 nt, Artificial Sequence
  Description of Artificial Sequence:  synthetic
cagagcccuucugguuggu

SEQ ID NO: 565 - RNA, 19 nt, Artificial Sequence
  Description of Artificial Sequence:  synthetic
gguaugcugaacuuuccac

SEQ ID NO: 566 - RNA, 19 nt, Artificial Sequence
  Description of Artificial Sequence:  synthetic
agguuccuugaacagugag

SEQ ID NO: 567 - RNA, 19 nt, Artificial Sequence
  Description of Artificial Sequence:  synthetic
ccagauuagacuuguccga

SEQ ID NO: 568 - RNA, 19 nt, Artificial Sequence
  Description of Artificial Sequence:  synthetic
auguuagagugaucagcuc

SEQ ID NO: 569 - RNA, 19 nt, Artificial Sequence
  Description of Artificial Sequence:  synthetic
ucgcagccacacaggugca

SEQ ID NO: 570 - RNA, 19 nt, Artificial Sequence
  Description of Artificial Sequence:  synthetic
auaggagccagaagagagu

SEQ ID NO: 571 - RNA, 19 nt, Artificial Sequence
  Description of Artificial Sequence:  synthetic
uucggauaaggaggguuaa

SEQ ID NO: 572 - RNA, 19 nt, Artificial Sequence
  Description of Artificial Sequence:  synthetic
aagaagaccuuuucauuuu

SEQ ID NO: 573 - RNA, 19 nt, Artificial Sequence
  Description of Artificial Sequence:  synthetic
agucagucuuuauuucaga

SEQ ID NO: 574 - RNA, 19 nt, Artificial Sequence
  Description of Artificial Sequence:  synthetic
ccauuauaauugauaggua

SEQ ID NO: 575 - RNA, 19 nt, Artificial Sequence
  Description of Artificial Sequence:  synthetic
aaggaacuucaucuggguc

SEQ ID NO: 576 - RNA, 19 nt, Artificial Sequence
  Description of Artificial Sequence:  synthetic
gcucacacugcucauccaa

SEQ ID NO: 577 - RNA, 19 nt, Artificial Sequence
  Description of Artificial Sequence:  synthetic
uggcaucauaagggagccg

SEQ ID NO: 578 - RNA, 19 nt, Artificial Sequence
  Description of Artificial Sequence:  synthetic
gggcaaacucccacuugcu

SEQ ID NO: 579 - RNA, 19 nt, Artificial Sequence
  Description of Artificial Sequence:  synthetic
ccaguuuaagucucucccg

SEQ ID NO: 580 - RNA, 19 nt, Artificial Sequence
  Description of Artificial Sequence:  synthetic
cucuuccaagugauuugcc

SEQ ID NO: 581 - RNA, 19 nt, Artificial Sequence
  Description of Artificial Sequence:  synthetic
ccacuuuuccaaaagcccc

SEQ ID NO: 582 - RNA, 19 nt, Artificial Sequence
  Description of Artificial Sequence:  synthetic
caaaugcugaugcuugaac

SEQ ID NO: 583 - RNA, 19 nt, Artificial Sequence
  Description of Artificial Sequence:  synthetic
uaggugauuucuuaaugcc

SEQ ID NO: 584 - RNA, 19 nt, Artificial Sequence
  Description of Artificial Sequence:  synthetic
cagccacaguccggcacgu

SEQ ID NO: 585 - RNA, 19 nt, Artificial Sequence
  Description of Artificial Sequence:  synthetic
ccucuuucagcauuuucac

SEQ ID NO: 586 - RNA, 19 nt, Artificial Sequence
  Description of Artificial Sequence:  synthetic
acucgcuggccguggcccc

SEQ ID NO: 587 - RNA, 19 nt, Artificial Sequence
  Description of Artificial Sequence:  synthetic
cagucaucagagcuuugua

SEQ ID NO: 588 - RNA, 19 nt, Artificial Sequence
  Description of Artificial Sequence:  synthetic
gggucaagauuuuuagcuc

SEQ ID NO: 589 - RNA, 19 nt, Artificial Sequence
  Description of Artificial Sequence:  synthetic
ucagaugguggccaaugug

SEQ ID NO: 590 - RNA, 19 nt, Artificial Sequence
  Description of Artificial Sequence:  synthetic
ccagcagguuaaccacguu

SEQ ID NO: 591 - RNA, 19 nt, Artificial Sequence
  Description of Artificial Sequence:  synthetic
cuugcuuggugcaggcucc

SEQ ID NO: 592 - RNA, 19 nt, Artificial Sequence
  Description of Artificial Sequence:  synthetic
ucaccaucagaggcccucc

SEQ ID NO: 593 - RNA, 19 nt, Artificial Sequence
  Description of Artificial Sequence:  synthetic
auuugcaguauucaacaau

SEQ ID NO: 594 - RNA, 19 nt, Artificial Sequence
  Description of Artificial Sequence:  synthetic
aguuggagagauuuccaua

SEQ ID NO: 595 - RNA, 19 nt, Artificial Sequence
  Description of Artificial Sequence:  synthetic
cacguuugcucuugaggua

SEQ ID NO: 596 - RNA, 19 nt, Artificial Sequence
  Description of Artificial Sequence:  synthetic
uguugagaaaaaauaaguc

SEQ ID NO: 597 - RNA, 19 nt, Artificial Sequence
  Description of Artificial Sequence:  synthetic
uguguagugcugcauccuu

SEQ ID NO: 598 - RNA, 19 nt, Artificial Sequence
  Description of Artificial Sequence:  synthetic
uuucuuucuuaggcuccau

SEQ ID NO: 599 - RNA, 19 nt, Artificial Sequence
  Description of Artificial Sequence:  synthetic
ccaggccuggcuccauuuu

SEQ ID NO: 600 - RNA, 19 nt, Artificial Sequence
  Description of Artificial Sequence:  synthetic
uugguuucuugccuuguuc

SEQ ID NO: 601 - RNA, 19 nt, Artificial Sequence
  Description of Artificial Sequence:  synthetic
uggugacgcuaucuagucu

SEQ ID NO: 602 - RNA, 19 nt, Artificial Sequence
  Description of Artificial Sequence:  synthetic
ucgcaaagcuuucgcugcu

SEQ ID NO: 603 - RNA, 19 nt, Artificial Sequence
  Description of Artificial Sequence:  synthetic
cuuccugaaagccggagcu

SEQ ID NO: 604 - RNA, 19 nt, Artificial Sequence
  Description of Artificial Sequence:  synthetic
caucacucagacuuuuauc

SEQ ID NO: 605 - RNA, 19 nt, Artificial Sequence
  Description of Artificial Sequence:  synthetic
aauccuccucuuccucaac

SEQ ID NO: 606 - RNA, 19 nt, Artificial Sequence
  Description of Artificial Sequence:  synthetic
ccuuguagaaaccgucaga

SEQ ID NO: 607 - RNA, 19 nt, Artificial Sequence
  Description of Artificial Sequence:  synthetic
cuuccauagugaugggcuc

SEQ ID NO: 608 - RNA, 19 nt, Artificial Sequence
  Description of Artificial Sequence:  synthetic
aacuguaagaaaucagauc

SEQ ID NO: 609 - RNA, 19 nt, Artificial Sequence
  Description of Artificial Sequence:  synthetic
ugccucuggccacuugaaa

SEQ ID NO: 610 - RNA, 19 nt, Artificial Sequence
  Description of Artificial Sequence:  synthetic
uggaagacaggaacuccau

SEQ ID NO: 611 - RNA, 19 nt, Artificial Sequence
  Description of Artificial Sequence:  synthetic
cccgaugaaugcacuuucu

SEQ ID NO: 612 - RNA, 19 nt, Artificial Sequence
  Description of Artificial Sequence:  synthetic
uguuucucgcugccagguc

SEQ ID NO: 613 - RNA, 19 nt, Artificial Sequence
  Description of Artificial Sequence:  synthetic
uguucucagauaaaagaau

SEQ ID NO: 614 - RNA, 19 nt, Artificial Sequence
  Description of Artificial Sequence:  synthetic
cacaaaucuucaccacguu

SEQ ID NO: 615 - RNA, 19 nt, Artificial Sequence
  Description of Artificial Sequence:  synthetic
cccgggcaaggccaaaauc

SEQ ID NO: 616 - RNA, 19 nt, Artificial Sequence
  Description of Artificial Sequence:  synthetic
cgggguucuuauaaauauc

SEQ ID NO: 617 - RNA, 19 nt, Artificial Sequence
  Description of Artificial Sequence:  synthetic
cuccuuuucucacauaauc

SEQ ID NO: 618 - RNA, 19 nt, Artificial Sequence
  Description of Artificial Sequence:  synthetic
ucagaggaagucgaguauc

SEQ ID NO: 619 - RNA, 19 nt, Artificial Sequence
  Description of Artificial Sequence:  synthetic
auucgggagccauccauuu

SEQ ID NO: 620 - RNA, 19 nt, Artificial Sequence
  Description of Artificial Sequence:  synthetic
agauuuugucaaagauaga

SEQ ID NO: 621 - RNA, 19 nt, Artificial Sequence
  Description of Artificial Sequence:  synthetic
cgucgcucuuggugcugua

SEQ ID NO: 622 - RNA, 19 nt, Artificial Sequence
  Description of Artificial Sequence:  synthetic
auacuccguaagaccacac

SEQ ID NO: 623 - RNA, 19 nt, Artificial Sequence
  Description of Artificial Sequence:  synthetic
agaagauuucccacagcaa

SEQ ID NO: 624 - RNA, 19 nt, Artificial Sequence
  Description of Artificial Sequence:  synthetic
auggagacccaccuaagga

SEQ ID NO: 625 - RNA, 19 nt, Artificial Sequence
  Description of Artificial Sequence:  synthetic
ccauuuguacuccugggua

SEQ ID NO: 626 - RNA, 19 nt, Artificial Sequence
  Description of Artificial Sequence:  synthetic
gacugcaaaaguccucauc

SEQ ID NO: 627 - RNA, 19 nt, Artificial Sequence
  Description of Artificial Sequence:  synthetic
ucaugccuucccucaggcg

SEQ ID NO: 628 - RNA, 19 nt, Artificial Sequence
  Description of Artificial Sequence:  synthetic
acucaggagcucucauccu

SEQ ID NO: 629 - RNA, 19 nt, Artificial Sequence
  Description of Artificial Sequence:  synthetic
agauuucaggaguagagua

SEQ ID NO: 630 - RNA, 19 nt, Artificial Sequence
  Description of Artificial Sequence:  synthetic
aguccagcaugaucugaua

SEQ ID NO: 631 - RNA, 19 nt, Artificial Sequence
  Description of Artificial Sequence:  synthetic
uugggucucugugccagca

SEQ ID NO: 632 - RNA, 19 nt, Artificial Sequence
  Description of Artificial Sequence:  synthetic
caaaucuuggccuuucuuu

SEQ ID NO: 633 - RNA, 19 nt, Artificial Sequence
  Description of Artificial Sequence:  synthetic
guuuuuccacaaguucugc

SEQ ID NO: 634 - RNA, 19 nt, Artificial Sequence
  Description of Artificial Sequence:  synthetic
cuugaagcaaaucaccuag

SEQ ID NO: 635 - RNA, 19 nt, Artificial Sequence
  Description of Artificial Sequence:  synthetic
cauccuguuguacauuugc

SEQ ID NO: 636 - RNA, 19 nt, Artificial Sequence
  Description of Artificial Sequence:  synthetic
uugggauguagucuuuacc

SEQ ID NO: 637 - RNA, 19 nt, Artificial Sequence
  Description of Artificial Sequence:  synthetic
cugucaguauggcauugau

SEQ ID NO: 638 - RNA, 19 nt, Artificial Sequence
  Description of Artificial Sequence:  synthetic
auguaaacccacuauuucc

SEQ ID NO: 639 - RNA, 19 nt, Artificial Sequence
  Description of Artificial Sequence:  synthetic
agaaggcaggaguugagua

SEQ ID NO: 640 - RNA, 19 nt, Artificial Sequence
  Description of Artificial Sequence:  synthetic
ccuugaagaaguccucaga

SEQ ID NO: 641 - RNA, 19 nt, Artificial Sequence
  Description of Artificial Sequence:  synthetic
ucggagcugaaauacuuuc

SEQ ID NO: 642 - RNA, 19 nt, Artificial Sequence
  Description of Artificial Sequence:  synthetic
agcuuccugaauuaaacuu

SEQ ID NO: 643 - RNA, 19 nt, Artificial Sequence
  Description of Artificial Sequence:  synthetic
cauaucugacaucaucaga

SEQ ID NO: 644 - RNA, 19 nt, Artificial Sequence
  Description of Artificial Sequence:  synthetic
ugaacuugaaagcauuuac

SEQ ID NO: 645 - RNA, 19 nt, Artificial Sequence
  Description of Artificial Sequence:  synthetic
ugauucuuuccaggcucau

SEQ ID NO: 646 - RNA, 19 nt, Artificial Sequence
  Description of Artificial Sequence:  synthetic
aaaguucuucaaagguuuu

SEQ ID NO: 647 - RNA, 19 nt, Artificial Sequence
  Description of Artificial Sequence:  synthetic
uggagguggcauucgguaa

SEQ ID NO: 648 - RNA, 19 nt, Artificial Sequence
  Description of Artificial Sequence:  synthetic
ccugguagucaucaaacau

SEQ ID NO: 649 - RNA, 19 nt, Artificial Sequence
  Description of Artificial Sequence:  synthetic
acagagugcugcugucgcc

SEQ ID NO: 650 - RNA, 19 nt, Artificial Sequence
  Description of Artificial Sequence:  synthetic
ucagcaugggagaggccaa

SEQ ID NO: 651 - RNA, 19 nt, Artificial Sequence
  Description of Artificial Sequence:  synthetic
caguccaggugaagcgcuu

SEQ ID NO: 652 - RNA, 19 nt, Artificial Sequence
  Description of Artificial Sequence:  synthetic
aggccuuggguuugcuguc

SEQ ID NO: 653 - RNA, 19 nt, Artificial Sequence
  Description of Artificial Sequence:  synthetic
ucaagucaaucuugagcga

SEQ ID NO: 654 - RNA, 19 nt, Artificial Sequence
  Description of Artificial Sequence:  synthetic
uacuuuuacugguuacucu

SEQ ID NO: 655 - RNA, 19 nt, Artificial Sequence
  Description of Artificial Sequence:  synthetic
cagacagccccgacuccuu

SEQ ID NO: 656 - RNA, 19 nt, Artificial Sequence
  Description of Artificial Sequence:  synthetic
aacugggccugcugacauc

SEQ ID NO: 657 - RNA, 19 nt, Artificial Sequence
  Description of Artificial Sequence:  synthetic
cacagcuggaauggcagaa

SEQ ID NO: 658 - RNA, 19 nt, Artificial Sequence
  Description of Artificial Sequence:  synthetic
ugccuucgcugacgugccc

SEQ ID NO: 659 - RNA, 19 nt, Artificial Sequence
  Description of Artificial Sequence:  synthetic
cguaggugaaccugcgcuu

SEQ ID NO: 660 - RNA, 19 nt, Artificial Sequence
  Description of Artificial Sequence:  synthetic
uuuccagcucagcgugguc

SEQ ID NO: 661 - RNA, 19 nt, Artificial Sequence
  Description of Artificial Sequence:  synthetic
agcagcacgcgauuuuccu

SEQ ID NO: 662 - RNA, 19 nt, Artificial Sequence
  Description of Artificial Sequence:  synthetic
uguagucugggggcgggga

SEQ ID NO: 663 - RNA, 19 nt, Artificial Sequence
  Description of Artificial Sequence:  synthetic
aguacaggaccaccgaguu

SEQ ID NO: 664 - RNA, 19 nt, Artificial Sequence
  Description of Artificial Sequence:  synthetic
ucuagauggguggggugga

SEQ ID NO: 665 - RNA, 19 nt, Artificial Sequence
  Description of Artificial Sequence:  synthetic
uaaggcuucgugucaaacu

SEQ ID NO: 666 - RNA, 19 nt, Artificial Sequence
  Description of Artificial Sequence:  synthetic
cacaugugcuucuagaaau

SEQ ID NO: 667 - RNA, 19 nt, Artificial Sequence
  Description of Artificial Sequence:  synthetic
uuccuggggguauaaauac

SEQ ID NO: 668 - RNA, 19 nt, Artificial Sequence
  Description of Artificial Sequence:  synthetic
auacuggcaaaagcuaguu

SEQ ID NO: 669 - RNA, 19 nt, Artificial Sequence
  Description of Artificial Sequence:  synthetic
uaaacuuauauaugcauaa

SEQ ID NO: 670 - RNA, 19 nt, Artificial Sequence
  Description of Artificial Sequence:  synthetic
cauggaaagauaaaggugu

SEQ ID NO: 671 - RNA, 19 nt, Artificial Sequence
  Description of Artificial Sequence:  synthetic
caaaaagcagcuggcuccc

SEQ ID NO: 672 - RNA, 19 nt, Artificial Sequence
  Description of Artificial Sequence:  synthetic
gcacuauuaaaaaaaucac

SEQ ID NO: 673 - RNA, 19 nt, Artificial Sequence
  Description of Artificial Sequence:  synthetic
guuagucaaaaaaaaaaag

SEQ ID NO: 674 - RNA, 19 nt, Artificial Sequence
  Description of Artificial Sequence:  synthetic
aucuggaguuacauucuug

SEQ ID NO: 675 - RNA, 19 nt, Artificial Sequence
  Description of Artificial Sequence:  synthetic
acuugucacuauuucucua

SEQ ID NO: 676 - RNA, 19 nt, Artificial Sequence
  Description of Artificial Sequence:  synthetic
uuagcaguaguguucuuca

SEQ ID NO: 677 - RNA, 19 nt, Artificial Sequence
  Description of Artificial Sequence:  synthetic
acugaguaacaugaggauu

SEQ ID NO: 678 - RNA, 19 nt, Artificial Sequence
  Description of Artificial Sequence:  synthetic
aggaaggauuucucuaaca

SEQ ID NO: 679 - RNA, 19 nt, Artificial Sequence
  Description of Artificial Sequence:  synthetic
agggaagucauuggguuua

SEQ ID NO: 680 - RNA, 19 nt, Artificial Sequence
  Description of Artificial Sequence:  synthetic
gguggcggggguuggagca

SEQ ID NO: 681 - RNA, 19 nt, Artificial Sequence
  Description of Artificial Sequence:  synthetic
ugguccugcgugcccugag

SEQ ID NO: 682 - RNA, 19 nt, Artificial Sequence
  Description of Artificial Sequence:  synthetic
gcagcuccucaaucaaacu

SEQ ID NO: 683 - RNA, 19 nt, Artificial Sequence
  Description of Artificial Sequence:  synthetic
augcauugggugaucagug

SEQ ID NO: 684 - RNA, 19 nt, Artificial Sequence
  Description of Artificial Sequence:  synthetic
ggcccagugggguacguga

SEQ ID NO: 685 - RNA, 19 nt, Artificial Sequence
  Description of Artificial Sequence:  synthetic
guuuugggcugcagggcug

SEQ ID NO: 686 - RNA, 19 nt, Artificial Sequence
  Description of Artificial Sequence:  synthetic
acgggcuuguugcccuggg

SEQ ID NO: 687 - RNA, 19 nt, Artificial Sequence
  Description of Artificial Sequence:  synthetic
agugauccccuggggcuaa

SEQ ID NO: 688 - RNA, 19 nt, Artificial Sequence
  Description of Artificial Sequence:  synthetic
auguugcucaggccagcca

SEQ ID NO: 689 - RNA, 19 nt, Artificial Sequence
  Description of Artificial Sequence:  synthetic
ugcuagaggacucccgaga

SEQ ID NO: 690 - RNA, 19 nt, Artificial Sequence
  Description of Artificial Sequence:  synthetic
ccucacaugucuuaggccu

SEQ ID NO: 691 - RNA, 19 nt, Artificial Sequence
  Description of Artificial Sequence:  synthetic
gcuuuuuuuccuuuuccuc

SEQ ID NO: 692 - RNA, 19 nt, Artificial Sequence
  Description of Artificial Sequence:  synthetic
uuuucucccuugcuuuuug

SEQ ID NO: 693 - RNA, 19 nt, Artificial Sequence
  Description of Artificial Sequence:  synthetic
gccuucucccgguuucucu

SEQ ID NO: 694 - RNA, 19 nt, Artificial Sequence
  Description of Artificial Sequence:  synthetic
ucucaaauucuuucucaug

SEQ ID NO: 695 - RNA, 19 nt, Artificial Sequence
  Description of Artificial Sequence:  synthetic
ccgugcccacauggugcgu

SEQ ID NO: 696 - RNA, 19 nt, Artificial Sequence
  Description of Artificial Sequence:  synthetic
gcugagccccgucccccuc

SEQ ID NO: 697 - RNA, 19 nt, Artificial Sequence
  Description of Artificial Sequence:  synthetic
agccacugaaauggcauug

SEQ ID NO: 698 - RNA, 19 nt, Artificial Sequence
  Description of Artificial Sequence:  synthetic
gaagggucagagcugggaa

SEQ ID NO: 699 - RNA, 19 nt, Artificial Sequence
  Description of Artificial Sequence:  synthetic
gcugggcccucaaauguag

SEQ ID NO: 700 - RNA, 19 nt, Artificial Sequence
  Description of Artificial Sequence:  synthetic
gcuguccaucugcuccugg

SEQ ID NO: 701 - RNA, 19 nt, Artificial Sequence
  Description of Artificial Sequence:  synthetic
agaaaauguccccucaucg

SEQ ID NO: 702 - RNA, 19 nt, Artificial Sequence
  Description of Artificial Sequence:  synthetic
ucuugccucccagaaucca

SEQ ID NO: 703 - RNA, 19 nt, Artificial Sequence
  Description of Artificial Sequence:  synthetic
aaaagauauuuguccuuuu

SEQ ID NO: 704 - RNA, 19 nt, Artificial Sequence
  Description of Artificial Sequence:  synthetic
aauuugcuuuaguuccaaa

SEQ ID NO: 705 - RNA, 19 nt, Artificial Sequence
  Description of Artificial Sequence:  synthetic
ccauagguaaaggucuaaa

SEQ ID NO: 706 - RNA, 19 nt, Artificial Sequence
  Description of Artificial Sequence:  synthetic
auggacauagaaccacuuc

SEQ ID NO: 707 - RNA, 19 nt, Artificial Sequence
  Description of Artificial Sequence:  synthetic
aacaugccacgaaugagaa

SEQ ID NO: 708 - RNA, 19 nt, Artificial Sequence
  Description of Artificial Sequence:  synthetic
cucagugcuacaaaucaaa

SEQ ID NO: 709 - RNA, 19 nt, Artificial Sequence
  Description of Artificial Sequence:  synthetic
ucagaguugagugccaccc

SEQ ID NO: 710 - RNA, 19 nt, Artificial Sequence
  Description of Artificial Sequence:  synthetic
ggagccaaaaguaugggcu

SEQ ID NO: 711 - RNA, 19 nt, Artificial Sequence
  Description of Artificial Sequence:  synthetic
ucagugcaucuuacuagag

SEQ ID NO: 712 - RNA, 19 nt, Artificial Sequence
  Description of Artificial Sequence:  synthetic
cuaacucuggcuaaguuuu

SEQ ID NO: 713 - RNA, 19 nt, Artificial Sequence
  Description of Artificial Sequence:  synthetic
ucauggccuggagacaacc

SEQ ID NO: 714 - RNA, 19 nt, Artificial Sequence
  Description of Artificial Sequence:  synthetic
auuuucaguguaaggccau

SEQ ID NO: 715 - RNA, 19 nt, Artificial Sequence
  Description of Artificial Sequence:  synthetic
cccaaaauagaaugugaca

SEQ ID NO: 716 - RNA, 19 nt, Artificial Sequence
  Description of Artificial Sequence:  synthetic
cuggacuauauauuaauac

SEQ ID NO: 717 - RNA, 19 nt, Artificial Sequence
  Description of Artificial Sequence:  synthetic
agaaauugaguuaaguguc

SEQ ID NO: 718 - RNA, 19 nt, Artificial Sequence
  Description of Artificial Sequence:  synthetic
caaaacagaauaauaccaa

SEQ ID NO: 719 - RNA, 19 nt, Artificial Sequence
  Description of Artificial Sequence:  synthetic
cuuucacaacuaacugugc

SEQ ID NO: 720 - RNA, 19 nt, Artificial Sequence
  Description of Artificial Sequence:  synthetic
uucauucuucucagcuuuc

SEQ ID NO: 721 - RNA, 19 nt, Artificial Sequence
  Description of Artificial Sequence:  synthetic
ucuccucaggacugcauuu

SEQ ID NO: 722 - RNA, 19 nt, Artificial Sequence
  Description of Artificial Sequence:  synthetic
uuuugauauggagaaaacu

SEQ ID NO: 723 - RNA, 19 nt, Artificial Sequence
  Description of Artificial Sequence:  synthetic
uuccuccaucagcccucgu

SEQ ID NO: 724 - RNA, 19 nt, Artificial Sequence
  Description of Artificial Sequence:  synthetic
uugaccuuauugaccuuuu

SEQ ID NO: 725 - RNA, 19 nt, Artificial Sequence
  Description of Artificial Sequence:  synthetic
uagagacggggucuucccu

SEQ ID NO: 726 - RNA, 19 nt, Artificial Sequence
  Description of Artificial Sequence:  synthetic
gaauugguuugguugguau

SEQ ID NO: 727 - RNA, 19 nt, Artificial Sequence
  Description of Artificial Sequence:  synthetic
ggucccaacuguguuggug

SEQ ID NO: 728 - RNA, 19 nt, Artificial Sequence
  Description of Artificial Sequence:  synthetic
cugacuuccuguguuuugg

SEQ ID NO: 729 - RNA, 19 nt, Artificial Sequence
  Description of Artificial Sequence:  synthetic
aaugaaaaggaaacgugac

SEQ ID NO: 730 - RNA, 19 nt, Artificial Sequence
  Description of Artificial Sequence:  synthetic
auaguggaauccccauuaa

SEQ ID NO: 731 - RNA, 19 nt, Artificial Sequence
  Description of Artificial Sequence:  synthetic
cuuucagauuagugugaga

SEQ ID NO: 732 - RNA, 19 nt, Artificial Sequence
  Description of Artificial Sequence:  synthetic
cuaaugcucuuccacaucc

SEQ ID NO: 733 - RNA, 19 nt, Artificial Sequence
  Description of Artificial Sequence:  synthetic
gugcuuaauaugcgccagc

SEQ ID NO: 734 - RNA, 19 nt, Artificial Sequence
  Description of Artificial Sequence:  synthetic
uuacucaaggagcuuaaag

SEQ ID NO: 735 - RNA, 19 nt, Artificial Sequence
  Description of Artificial Sequence:  synthetic
aaauuacauaccaccuuuu

SEQ ID NO: 736 - RNA, 19 nt, Artificial Sequence
  Description of Artificial Sequence:  synthetic
uggagaaauaccuugcaua

SEQ ID NO: 737 - RNA, 19 nt, Artificial Sequence
  Description of Artificial Sequence:  synthetic
aauauccugagucccaacu

SEQ ID NO: 738 - RNA, 19 nt, Artificial Sequence
  Description of Artificial Sequence:  synthetic
agugauggcucauuaacua

SEQ ID NO: 739 - RNA, 19 nt, Artificial Sequence
  Description of Artificial Sequence:  synthetic
aaaaugggcuuuucuucua

SEQ ID NO: 740 - RNA, 19 nt, Artificial Sequence
  Description of Artificial Sequence:  synthetic
caaguuucaaagcaguuga

SEQ ID NO: 741 - RNA, 19 nt, Artificial Sequence
  Description of Artificial Sequence:  synthetic
ucaugcucagaccccaggc

SEQ ID NO: 742 - RNA, 19 nt, Artificial Sequence
  Description of Artificial Sequence:  synthetic
ccugucucccuauucccau

SEQ ID NO: 743 - RNA, 19 nt, Artificial Sequence
  Description of Artificial Sequence:  synthetic
guaggcgcccuuuccuacc

SEQ ID NO: 744 - RNA, 19 nt, Artificial Sequence
  Description of Artificial Sequence:  synthetic
aucuuuagacccugaagag

SEQ ID NO: 745 - RNA, 19 nt, Artificial Sequence
  Description of Artificial Sequence:  synthetic
cgauccaaggcccacuuga

SEQ ID NO: 746 - RNA, 19 nt, Artificial Sequence
  Description of Artificial Sequence:  synthetic
caaacagagccagcuuagc

SEQ ID NO: 747 - RNA, 19 nt, Artificial Sequence
  Description of Artificial Sequence:  synthetic
aacuugcauaaauagcauc

SEQ ID NO: 748 - RNA, 19 nt, Artificial Sequence
  Description of Artificial Sequence:  synthetic
ccuaaauacauagacccua

SEQ ID NO: 749 - RNA, 19 nt, Artificial Sequence
  Description of Artificial Sequence:  synthetic
ccugaagaguaggcgcauc

SEQ ID NO: 750 - RNA, 19 nt, Artificial Sequence
  Description of Artificial Sequence:  synthetic
cccacuugaucuuuagacc

SEQ ID NO: 751 - RNA, 19 nt, Artificial Sequence
  Description of Artificial Sequence:  synthetic
cagcuuagcgauccaaggc

SEQ ID NO: 752 - RNA, 19 nt, Artificial Sequence
  Description of Artificial Sequence:  synthetic
aauagcaucaaacagagcc

SEQ ID NO: 753 - RNA, 19 nt, Artificial Sequence
  Description of Artificial Sequence:  synthetic
uagacccuaacuugcauaa

SEQ ID NO: 754 - RNA, 19 nt, Artificial Sequence
  Description of Artificial Sequence:  synthetic
gcagacauccuaaauacau

SEQ ID NO: 755 - RNA, 19 nt, Artificial Sequence
  Description of Artificial Sequence:  synthetic
ugacuggcugcagaaggug

SEQ ID NO: 756 - RNA, 19 nt, Artificial Sequence
  Description of Artificial Sequence:  synthetic
uguugccucuccagcuucu

SEQ ID NO: 757 - RNA, 19 nt, Artificial Sequence
  Description of Artificial Sequence:  synthetic
caagaagcagcaauccacu

SEQ ID NO: 758 - RNA, 19 nt, Artificial Sequence
  Description of Artificial Sequence:  synthetic
gaagcauacucuucucccc

SEQ ID NO: 759 - RNA, 19 nt, Artificial Sequence
  Description of Artificial Sequence:  synthetic
aaauuacauggauaaaagg

SEQ ID NO: 760 - RNA, 19 nt, Artificial Sequence
  Description of Artificial Sequence:  synthetic
agcucagguucuacaguua

SEQ ID NO: 761 - RNA, 19 nt, Artificial Sequence
  Description of Artificial Sequence:  synthetic
cauucuucgguuacuuaga

SEQ ID NO: 762 - RNA, 19 nt, Artificial Sequence
  Description of Artificial Sequence:  synthetic
cauaagaacagaggcauac

SEQ ID NO: 763 - RNA, 19 nt, Artificial Sequence
  Description of Artificial Sequence:  synthetic
uuaaacaaggauguggcac

SEQ ID NO: 764 - RNA, 19 nt, Artificial Sequence
  Description of Artificial Sequence:  synthetic
ucuucauacagagagccuu

SEQ ID NO: 765 - RNA, 19 nt, Artificial Sequence
  Description of Artificial Sequence:  synthetic
gcugaugacggucccaucu

SEQ ID NO: 766 - RNA, 19 nt, Artificial Sequence
  Description of Artificial Sequence:  synthetic
aggcucacuagggaaugug

SEQ ID NO: 767 - RNA, 19 nt, Artificial Sequence
  Description of Artificial Sequence:  synthetic
ccgcugccaggagccagua

SEQ ID NO: 768 - RNA, 19 nt, Artificial Sequence
  Description of Artificial Sequence:  synthetic
gugagucuuccacaaaagc

SEQ ID NO: 769 - RNA, 19 nt, Artificial Sequence
  Description of Artificial Sequence:  synthetic
acuccucucuucuggcuag

SEQ ID NO: 770 - RNA, 19 nt, Artificial Sequence
  Description of Artificial Sequence:  synthetic
gguggagaggacuguccca

SEQ ID NO: 771 - RNA, 19 nt, Artificial Sequence
  Description of Artificial Sequence:  synthetic
uguuuggauuuagaucuug

SEQ ID NO: 772 - RNA, 19 nt, Artificial Sequence
  Description of Artificial Sequence:  synthetic
cuggcucuagccugcuuuu

SEQ ID NO: 773 - RNA, 19 nt, Artificial Sequence
  Description of Artificial Sequence:  synthetic
aaagauuuguccucucuuc

SEQ ID NO: 774 - RNA, 19 nt, Artificial Sequence
  Description of Artificial Sequence:  synthetic
guaaagaagaggaacaaca

SEQ ID NO: 775 - RNA, 19 nt, Artificial Sequence
  Description of Artificial Sequence:  synthetic
caggugguuugcguaugug

SEQ ID NO: 776 - RNA, 19 nt, Artificial Sequence
  Description of Artificial Sequence:  synthetic
uaaaauugccagcugucac

SEQ ID NO: 777 - RNA, 19 nt, Artificial Sequence
  Description of Artificial Sequence:  synthetic
uuccaguuaccugauuuau

SEQ ID NO: 778 - RNA, 19 nt, Artificial Sequence
  Description of Artificial Sequence:  synthetic
uuucugaguuuaaccuccu

SEQ ID NO: 779 - RNA, 19 nt, Artificial Sequence
  Description of Artificial Sequence:  synthetic
uugacugaggucuucuuuu

SEQ ID NO: 780 - RNA, 19 nt, Artificial Sequence
  Description of Artificial Sequence:  synthetic
aaaaaaaaaaguagagaau

SEQ ID NO: 781 - RNA, 19 nt, Artificial Sequence
  Description of Artificial Sequence:  synthetic
uaucugauuuggaaaaaaa

SEQ ID NO: 782 - RNA, 19 nt, Artificial Sequence
  Description of Artificial Sequence:  synthetic
cacuauuugcugggcuauu

SEQ ID NO: 783 - RNA, 19 nt, Artificial Sequence
  Description of Artificial Sequence:  synthetic
uaagguuuuauuuguuauc

SEQ ID NO: 784 - RNA, 19 nt, Artificial Sequence
  Description of Artificial Sequence:  synthetic
aaucaagacaugaacagcu

SEQ ID NO: 785 - RNA, 19 nt, Artificial Sequence
  Description of Artificial Sequence:  synthetic
uuaagaauuaauuauugaa

SEQ ID NO: 786 - RNA, 19 nt, Artificial Sequence
  Description of Artificial Sequence:  synthetic
auuauggucucuuaaugau

SEQ ID NO: 787 - RNA, 19 nt, Artificial Sequence
  Description of Artificial Sequence:  synthetic
ucuugaaaaggaguauuua

SEQ ID NO: 788 - RNA, 19 nt, Artificial Sequence
  Description of Artificial Sequence:  synthetic
cuaaugguuuugcuuuucu

SEQ ID NO: 789 - RNA, 19 nt, Artificial Sequence
  Description of Artificial Sequence:  synthetic
aggagcugaguaacaauuc

SEQ ID NO: 790 - RNA, 19 nt, Artificial Sequence
  Description of Artificial Sequence:  synthetic
cuacaaaccugaguuugaa

SEQ ID NO: 791 - RNA, 19 nt, Artificial Sequence
  Description of Artificial Sequence:  synthetic
uggauggacucauguaugc

SEQ ID NO: 792 - RNA, 19 nt, Artificial Sequence
  Description of Artificial Sequence:  synthetic
gaaccauucuuugacugau

SEQ ID NO: 793 - RNA, 19 nt, Artificial Sequence
  Description of Artificial Sequence:  synthetic
acauuaagacuccagaugg

SEQ ID NO: 794 - RNA, 19 nt, Artificial Sequence
  Description of Artificial Sequence:  synthetic
gucuccauuuuucuuucua

SEQ ID NO: 795 - RNA, 19 nt, Artificial Sequence
  Description of Artificial Sequence:  synthetic
acuagcucauuauuacaag

SEQ ID NO: 796 - RNA, 19 nt, Artificial Sequence
  Description of Artificial Sequence:  synthetic
augaacaagcacuuuguaa

SEQ ID NO: 797 - RNA, 19 nt, Artificial Sequence
  Description of Artificial Sequence:  synthetic
auuuucagugcuauuuuaa

SEQ ID NO: 798 - RNA, 19 nt, Artificial Sequence
  Description of Artificial Sequence:  synthetic
caguuaauucauguuucaa

SEQ ID NO: 799 - RNA, 19 nt, Artificial Sequence
  Description of Artificial Sequence:  synthetic
aaaugauuggaauauuauc

SEQ ID NO: 800 - RNA, 19 nt, Artificial Sequence
  Description of Artificial Sequence:  synthetic
auuuuugucauaaauggca

SEQ ID NO: 801 - RNA, 19 nt, Artificial Sequence
  Description of Artificial Sequence:  synthetic
ucuuuguuagugccaacca

SEQ ID NO: 802 - RNA, 19 nt, Artificial Sequence
  Description of Artificial Sequence:  synthetic
cugaaaggaagugcucguu

SEQ ID NO: 803 - RNA, 19 nt, Artificial Sequence
  Description of Artificial Sequence:  synthetic
uacauuaucucagaaacuc

SEQ ID NO: 804 - RNA, 19 nt, Artificial Sequence
  Description of Artificial Sequence:  synthetic
cacccagacuguuccacgu

SEQ ID NO: 805 - RNA, 19 nt, Artificial Sequence
  Description of Artificial Sequence:  synthetic
augguuucagccccauucc

SEQ ID NO: 806 - RNA, 19 nt, Artificial Sequence
  Description of Artificial Sequence:  synthetic
caagacacagacuugcaca

SEQ ID NO: 807 - RNA, 19 nt, Artificial Sequence
  Description of Artificial Sequence:  synthetic
ugucacuucuuggacugac

SEQ ID NO: 808 - RNA, 19 nt, Artificial Sequence
  Description of Artificial Sequence:  synthetic
cuaaaauuaacaucucggu

SEQ ID NO: 809 - RNA, 19 nt, Artificial Sequence
  Description of Artificial Sequence:  synthetic
gaaacaaggcacggguccc

SEQ ID NO: 810 - RNA, 19 nt, Artificial Sequence
  Description of Artificial Sequence:  synthetic
ugcauucuugugggcuagg

SEQ ID NO: 811 - RNA, 19 nt, Artificial Sequence
  Description of Artificial Sequence:  synthetic
gaguaucuguuugauguuu

SEQ ID NO: 812 - RNA, 19 nt, Artificial Sequence
  Description of Artificial Sequence:  synthetic
aauuuaaaugaggcuagcg

SEQ ID NO: 813 - RNA, 19 nt, Artificial Sequence
  Description of Artificial Sequence:  synthetic
ugcacuccuccuuuaauca

SEQ ID NO: 814 - RNA, 19 nt, Artificial Sequence
  Description of Artificial Sequence:  synthetic
accacugucggccaaagau

SEQ ID NO: 815 - RNA, 19 nt, Artificial Sequence
  Description of Artificial Sequence:  synthetic
acacacacacacaguuaca

SEQ ID NO: 816 - RNA, 19 nt, Artificial Sequence
  Description of Artificial Sequence:  synthetic
acacacacacacacacaca

SEQ ID NO: 817 - RNA, 19 nt, Artificial Sequence
  Description of Artificial Sequence:  synthetic
ccacacccacacacacaca

SEQ ID NO: 818 - RNA, 19 nt, Artificial Sequence
  Description of Artificial Sequence:  synthetic
cacaaaacacacauacacc

SEQ ID NO: 819 - RNA, 19 nt, Artificial Sequence
  Description of Artificial Sequence:  synthetic
uuuccuuaaauaguuaugc

SEQ ID NO: 820 - RNA, 19 nt, Artificial Sequence
  Description of Artificial Sequence:  synthetic
guaacuuuaaaauuccagu

SEQ ID NO: 821 - RNA, 19 nt, Artificial Sequence
  Description of Artificial Sequence:  synthetic
uucuugguuuguauaaaag

SEQ ID NO: 822 - RNA, 19 nt, Artificial Sequence
  Description of Artificial Sequence:  synthetic
uuauaucuguagcauauau

SEQ ID NO: 823 - RNA, 19 nt, Artificial Sequence
  Description of Artificial Sequence:  synthetic
gaccaaaccaugucugucu

SEQ ID NO: 824 - RNA, 19 nt, Artificial Sequence
  Description of Artificial Sequence:  synthetic
ucaugacuagaaauauagg

SEQ ID NO: 825 - RNA, 19 nt, Artificial Sequence
  Description of Artificial Sequence:  synthetic
guauacaaaauacauucau

SEQ ID NO: 826 - RNA, 19 nt, Artificial Sequence
  Description of Artificial Sequence:  synthetic
guauauuauaugaagaugg

SEQ ID NO: 827 - RNA, 19 nt, Artificial Sequence
  Description of Artificial Sequence:  synthetic
auuaagaaauauuuuuaag

SEQ ID NO: 828 - RNA, 19 nt, Artificial Sequence
  Description of Artificial Sequence:  synthetic
guacgauuacaaaucccaa

SEQ ID NO: 829 - RNA, 19 nt, Artificial Sequence
  Description of Artificial Sequence:  synthetic
aguuuaucaauuaaguugg

SEQ ID NO: 830 - RNA, 19 nt, Artificial Sequence
  Description of Artificial Sequence:  synthetic
acauaaaagcaguugccaa

SEQ ID NO: 831 - RNA, 19 nt, Artificial Sequence
  Description of Artificial Sequence:  synthetic
uuuauggaaggagacagaa

SEQ ID NO: 832 - RNA, 19 nt, Artificial Sequence
  Description of Artificial Sequence:  synthetic
aauuaguauuuugaaaaau

SEQ ID NO: 833 - RNA, 19 nt, Artificial Sequence
  Description of Artificial Sequence:  synthetic
agagcuuuuucuuuguuga

SEQ ID NO: 834 - RNA, 19 nt, Artificial Sequence
  Description of Artificial Sequence:  synthetic
uuuauuuuaggaaaaaaaa

SEQ ID NO: 835 - RNA, 19 nt, Artificial Sequence
  Description of Artificial Sequence:  synthetic
aacaaggauaaauuugagu

SEQ ID NO: 836 - RNA, 19 nt, Artificial Sequence
  Description of Artificial Sequence:  synthetic
uaauuuuucucugcucuaa

SEQ ID NO: 837 - RNA, 19 nt, Artificial Sequence
  Description of Artificial Sequence:  synthetic
ccauuucaaaguuuuucuu

SEQ ID NO: 838 - RNA, 19 nt, Artificial Sequence
  Description of Artificial Sequence:  synthetic
uuuagcaauuuuuugagac

SEQ ID NO: 839 - RNA, 19 nt, Artificial Sequence
  Description of Artificial Sequence:  synthetic
aguuuuccauugaaaauau

SEQ ID NO: 840 - RNA, 19 nt, Artificial Sequence
  Description of Artificial Sequence:  synthetic
ucagcuaaacuaacauuua

SEQ ID NO: 841 - RNA, 19 nt, Artificial Sequence
  Description of Artificial Sequence:  synthetic
uucgaaaaccccauacaau

SEQ ID NO: 842 - RNA, 19 nt, Artificial Sequence
  Description of Artificial Sequence:  synthetic
caaacaaaaagugaaaggu

SEQ ID NO: 843 - RNA, 19 nt, Artificial Sequence
  Description of Artificial Sequence:  synthetic
guugugaaauagguaaaac

SEQ ID NO: 844 - RNA, 19 nt, Artificial Sequence
  Description of Artificial Sequence:  synthetic
uuauuggcaauuuacacag

SEQ ID NO: 845 - RNA, 19 nt, Artificial Sequence
  Description of Artificial Sequence:  synthetic
cauuuucauggacaggaau

SEQ ID NO: 846 - RNA, 19 nt, Artificial Sequence
  Description of Artificial Sequence:  synthetic
ucuacacuggauaauuugc

SEQ ID NO: 847 - RNA, 19 nt, Artificial Sequence
  Description of Artificial Sequence:  synthetic
gggugauggucaaauauau

SEQ ID NO: 848 - RNA, 19 nt, Artificial Sequence
  Description of Artificial Sequence:  synthetic
aacuagccaauauccauag

SEQ ID NO: 849 - RNA, 19 nt, Artificial Sequence
  Description of Artificial Sequence:  synthetic
uuugcuuaauaaaggcaaa

SEQ ID NO: 850 - RNA, 19 nt, Artificial Sequence
  Description of Artificial Sequence:  synthetic
cauucaggcugaaaugaau

SEQ ID NO: 851 - RNA, 19 nt, Artificial Sequence
  Description of Artificial Sequence:  synthetic
agagaauauauaggcagac

SEQ ID NO: 852 - RNA, 19 nt, Artificial Sequence
  Description of Artificial Sequence:  synthetic
aaggagaauacaaagagca

SEQ ID NO: 853 - RNA, 19 nt, Artificial Sequence
  Description of Artificial Sequence:  synthetic
gauguuuuaacggguucaa

SEQ ID NO: 854 - RNA, 19 nt, Artificial Sequence
  Description of Artificial Sequence:  synthetic
gagugccacaggauguuuu

SEQ ID NO: 855 - RNA, 19 nt, Artificial Sequence
  Description of Artificial Sequence:  synthetic
acugagucccgggaccccg

SEQ ID NO: 856 - RNA, 19 nt, Artificial Sequence
  Description of Artificial Sequence:  synthetic
gggagagcggucagugugu

SEQ ID NO: 857 - RNA, 19 nt, Artificial Sequence
  Description of Artificial Sequence:  synthetic
uggucgcugcguuuccucu

SEQ ID NO: 858 - RNA, 19 nt, Artificial Sequence
  Description of Artificial Sequence:  synthetic
ugccugcgccgggcaucac

SEQ ID NO: 859 - RNA, 19 nt, Artificial Sequence
  Description of Artificial Sequence:  synthetic
cuugcgcgccgcagaaagu

SEQ ID NO: 860 - RNA, 19 nt, Artificial Sequence
  Description of Artificial Sequence:  synthetic
uccgucuggcagccuggau

SEQ ID NO: 861 - RNA, 19 nt, Artificial Sequence
  Description of Artificial Sequence:  synthetic
uauccucuccuaccggcac

SEQ ID NO: 862 - RNA, 19 nt, Artificial Sequence
  Description of Artificial Sequence:  synthetic
cccgcagacgccccugcag

SEQ ID NO: 863 - RNA, 19 nt, Artificial Sequence
  Description of Artificial Sequence:  synthetic
gccgccggucggcgcccgg

SEQ ID NO: 864 - RNA, 19 nt, Artificial Sequence
  Description of Artificial Sequence:  synthetic
ggcucccuagcccugugcg

SEQ ID NO: 865 - RNA, 19 nt, Artificial Sequence
  Description of Artificial Sequence:  synthetic
gcucaacuguccugcgcug

SEQ ID NO: 866 - RNA, 19 nt, Artificial Sequence
  Description of Artificial Sequence:  synthetic
gcggggugccgcgaguucc

SEQ ID NO: 867 - RNA, 19 nt, Artificial Sequence
  Description of Artificial Sequence:  synthetic
caccuccgcgccuccuucu

SEQ ID NO: 868 - RNA, 19 nt, Artificial Sequence
  Description of Artificial Sequence:  synthetic
ucuagacaggcgcugggag

SEQ ID NO: 869 - RNA, 19 nt, Artificial Sequence
  Description of Artificial Sequence:  synthetic
gaaagaaccggcucccgag

SEQ ID NO: 870 - RNA, 19 nt, Artificial Sequence
  Description of Artificial Sequence:  synthetic
guucugggcauuucgcccg

SEQ ID NO: 871 - RNA, 19 nt, Artificial Sequence
  Description of Artificial Sequence:  synthetic
ggcucgaggugcaggaugc

SEQ ID NO: 872 - RNA, 19 nt, Artificial Sequence
  Description of Artificial Sequence:  synthetic
cagagcaaggugcugcugg

SEQ ID NO: 873 - RNA, 19 nt, Artificial Sequence
  Description of Artificial Sequence:  synthetic
gccgucgcccuguggcucu

SEQ ID NO: 874 - RNA, 19 nt, Artificial Sequence
  Description of Artificial Sequence:  synthetic
ugcguggagacccgggccg

SEQ ID NO: 875 - RNA, 19 nt, Artificial Sequence
  Description of Artificial Sequence:  synthetic
gccucuguggguuugccua

SEQ ID NO: 876 - RNA, 19 nt, Artificial Sequence
  Description of Artificial Sequence:  synthetic
aguguuucucuugaucugc

SEQ ID NO: 877 - RNA, 19 nt, Artificial Sequence
  Description of Artificial Sequence:  synthetic
cccaggcucagcauacaaa

SEQ ID NO: 878 - RNA, 19 nt, Artificial Sequence
  Description of Artificial Sequence:  synthetic
aaagacauacuuacaauua

SEQ ID NO: 879 - RNA, 19 nt, Artificial Sequence
  Description of Artificial Sequence:  synthetic
aaggcuaauacaacucuuc

SEQ ID NO: 880 - RNA, 19 nt, Artificial Sequence
  Description of Artificial Sequence:  synthetic
caaauuacuugcaggggac

SEQ ID NO: 881 - RNA, 19 nt, Artificial Sequence
  Description of Artificial Sequence:  synthetic
cagagggacuuggacuggc

SEQ ID NO: 882 - RNA, 19 nt, Artificial Sequence
  Description of Artificial Sequence:  synthetic
cuuuggcccaauaaucaga

SEQ ID NO: 883 - RNA, 19 nt, Artificial Sequence
  Description of Artificial Sequence:  synthetic
aguggcagugagcaaaggg

SEQ ID NO: 884 - RNA, 19 nt, Artificial Sequence
  Description of Artificial Sequence:  synthetic
guggaggugacugagugca

SEQ ID NO: 885 - RNA, 19 nt, Artificial Sequence
  Description of Artificial Sequence:  synthetic
agcgauggccucuucugua

SEQ ID NO: 886 - RNA, 19 nt, Artificial Sequence
  Description of Artificial Sequence:  synthetic
aagacacucacaauuccaa

SEQ ID NO: 887 - RNA, 19 nt, Artificial Sequence
  Description of Artificial Sequence:  synthetic
aaagugaucggaaaugaca

SEQ ID NO: 888 - RNA, 19 nt, Artificial Sequence
  Description of Artificial Sequence:  synthetic
acuggagccuacaagugcu

SEQ ID NO: 889 - RNA, 19 nt, Artificial Sequence
  Description of Artificial Sequence:  synthetic
uucuaccgggaaacugacu

SEQ ID NO: 890 - RNA, 19 nt, Artificial Sequence
  Description of Artificial Sequence:  synthetic
uuggccucggucauuuaug

SEQ ID NO: 891 - RNA, 19 nt, Artificial Sequence
  Description of Artificial Sequence:  synthetic
gucuauguucaagauuaca

SEQ ID NO: 892 - RNA, 19 nt, Artificial Sequence
  Description of Artificial Sequence:  synthetic
agaucuccauuuauugcuu

SEQ ID NO: 893 - RNA, 19 nt, Artificial Sequence
  Description of Artificial Sequence:  synthetic
ucuguuagugaccaacaug

SEQ ID NO: 894 - RNA, 19 nt, Artificial Sequence
  Description of Artificial Sequence:  synthetic
ggagucguguacauuacug

SEQ ID NO: 895 - RNA, 19 nt, Artificial Sequence
  Description of Artificial Sequence:  synthetic
gagaacaaaaacaaaacug

SEQ ID NO: 896 - RNA, 19 nt, Artificial Sequence
  Description of Artificial Sequence:  synthetic
guggugauuccaugucucg

SEQ ID NO: 897 - RNA, 19 nt, Artificial Sequence
  Description of Artificial Sequence:  synthetic
ggguccauuucaaaucuca

SEQ ID NO: 898 - RNA, 19 nt, Artificial Sequence
  Description of Artificial Sequence:  synthetic
aacgugucacuuugugcaa

SEQ ID NO: 899 - RNA, 19 nt, Artificial Sequence
  Description of Artificial Sequence:  synthetic
agauacccagaaaagagau

SEQ ID NO: 900 - RNA, 19 nt, Artificial Sequence
  Description of Artificial Sequence:  synthetic
uuuguuccugaugguaaca

SEQ ID NO: 901 - RNA, 19 nt, Artificial Sequence
  Description of Artificial Sequence:  synthetic
agaauuuccugggacagca

SEQ ID NO: 902 - RNA, 19 nt, Artificial Sequence
  Description of Artificial Sequence:  synthetic
aagaagggcuuuacuauuc

SEQ ID NO: 903 - RNA, 19 nt, Artificial Sequence
  Description of Artificial Sequence:  synthetic
cccagcuacaugaucagcu

SEQ ID NO: 904 - RNA, 19 nt, Artificial Sequence
  Description of Artificial Sequence:  synthetic
uaugcuggcauggucuucu

SEQ ID NO: 905 - RNA, 19 nt, Artificial Sequence
  Description of Artificial Sequence:  synthetic
ugugaagcaaaaauuaaug

SEQ ID NO: 906 - RNA, 19 nt, Artificial Sequence
  Description of Artificial Sequence:  synthetic
gaugaaaguuaccagucua

SEQ ID NO: 907 - RNA, 19 nt, Artificial Sequence
  Description of Artificial Sequence:  synthetic
auuauguacauaguugucg

SEQ ID NO: 908 - RNA, 19 nt, Artificial Sequence
  Description of Artificial Sequence:  synthetic
guuguaggguauaggauuu

SEQ ID NO: 909 - RNA, 19 nt, Artificial Sequence
  Description of Artificial Sequence:  synthetic
uaugaugugguucugaguc

SEQ ID NO: 910 - RNA, 19 nt, Artificial Sequence
  Description of Artificial Sequence:  synthetic
ccgucucauggaauugaac

SEQ ID NO: 911 - RNA, 19 nt, Artificial Sequence
  Description of Artificial Sequence:  synthetic
cuaucuguuggagaaaagc

SEQ ID NO: 912 - RNA, 19 nt, Artificial Sequence
  Description of Artificial Sequence:  synthetic
cuugucuuaaauuguacag

SEQ ID NO: 913 - RNA, 19 nt, Artificial Sequence
  Description of Artificial Sequence:  synthetic
gcaagaacugaacuaaaug

SEQ ID NO: 914 - RNA, 19 nt, Artificial Sequence
  Description of Artificial Sequence:  synthetic
guggggauugacuucaacu

SEQ ID NO: 915 - RNA, 19 nt, Artificial Sequence
  Description of Artificial Sequence:  synthetic
ugggaauacccuucuucga

SEQ ID NO: 916 - RNA, 19 nt, Artificial Sequence
  Description of Artificial Sequence:  synthetic
aagcaucagcauaagaaac

SEQ ID NO: 917 - RNA, 19 nt, Artificial Sequence
  Description of Artificial Sequence:  synthetic
cuuguaaaccgagaccuaa

SEQ ID NO: 918 - RNA, 19 nt, Artificial Sequence
  Description of Artificial Sequence:  synthetic
aaaacccagucugggagug

SEQ ID NO: 919 - RNA, 19 nt, Artificial Sequence
  Description of Artificial Sequence:  synthetic
gagaugaagaaauuuuuga

SEQ ID NO: 920 - RNA, 19 nt, Artificial Sequence
  Description of Artificial Sequence:  synthetic
agcaccuuaacuauagaug

SEQ ID NO: 921 - RNA, 19 nt, Artificial Sequence
  Description of Artificial Sequence:  synthetic
gguguaacccggagugacc

SEQ ID NO: 922 - RNA, 19 nt, Artificial Sequence
  Description of Artificial Sequence:  synthetic
caaggauuguacaccugug

SEQ ID NO: 923 - RNA, 19 nt, Artificial Sequence
  Description of Artificial Sequence:  synthetic
gcagcauccagugggcuga

SEQ ID NO: 924 - RNA, 19 nt, Artificial Sequence
  Description of Artificial Sequence:  synthetic
augaccaagaagaacagca

SEQ ID NO: 925 - RNA, 19 nt, Artificial Sequence
  Description of Artificial Sequence:  synthetic
acauuugucaggguccaug

SEQ ID NO: 926 - RNA, 19 nt, Artificial Sequence
  Description of Artificial Sequence:  synthetic
gaaaaaccuuuuguugcuu

SEQ ID NO: 927 - RNA, 19 nt, Artificial Sequence
  Description of Artificial Sequence:  synthetic
uuuggaaguggcauggaau

SEQ ID NO: 928 - RNA, 19 nt, Artificial Sequence
  Description of Artificial Sequence:  synthetic
ucucugguggaagccacgg

SEQ ID NO: 929 - RNA, 19 nt, Artificial Sequence
  Description of Artificial Sequence:  synthetic
gugggggagcgugucagaa

SEQ ID NO: 930 - RNA, 19 nt, Artificial Sequence
  Description of Artificial Sequence:  synthetic
aucccugcgaaguaccuug

SEQ ID NO: 931 - RNA, 19 nt, Artificial Sequence
  Description of Artificial Sequence:  synthetic
gguuacccacccccagaaa

SEQ ID NO: 932 - RNA, 19 nt, Artificial Sequence
  Description of Artificial Sequence:  synthetic
auaaaaugguauaaaaaug

SEQ ID NO: 933 - RNA, 19 nt, Artificial Sequence
  Description of Artificial Sequence:  synthetic
ggaauaccccuugagucca

SEQ ID NO: 934 - RNA, 19 nt, Artificial Sequence
  Description of Artificial Sequence:  synthetic
aaucacacaauuaaagcgg

SEQ ID NO: 935 - RNA, 19 nt, Artificial Sequence
  Description of Artificial Sequence:  synthetic
gggcauguacugacgauua

SEQ ID NO: 936 - RNA, 19 nt, Artificial Sequence
  Description of Artificial Sequence:  synthetic
auggaagugagugaaagag

SEQ ID NO: 937 - RNA, 19 nt, Artificial Sequence
  Description of Artificial Sequence:  synthetic
gacacaggaaauuacacug

SEQ ID NO: 938 - RNA, 19 nt, Artificial Sequence
  Description of Artificial Sequence:  synthetic
gucauccuuaccaauccca

SEQ ID NO: 939 - RNA, 19 nt, Artificial Sequence
  Description of Artificial Sequence:  synthetic
auuucaaaggagaagcaga

SEQ ID NO: 940 - RNA, 19 nt, Artificial Sequence
  Description of Artificial Sequence:  synthetic
agccauguggucucucugg

SEQ ID NO: 941 - RNA, 19 nt, Artificial Sequence
  Description of Artificial Sequence:  synthetic
guuguguaugucccacccc

SEQ ID NO: 942 - RNA, 19 nt, Artificial Sequence
  Description of Artificial Sequence:  synthetic
cagauuggugagaaaucuc

SEQ ID NO: 943 - RNA, 19 nt, Artificial Sequence
  Description of Artificial Sequence:  synthetic
cuaaucucuccuguggauu

SEQ ID NO: 944 - RNA, 19 nt, Artificial Sequence
  Description of Artificial Sequence:  synthetic
uccuaccaguacggcacca

SEQ ID NO: 945 - RNA, 19 nt, Artificial Sequence
  Description of Artificial Sequence:  synthetic
acucaaacgcugacaugua

SEQ ID NO: 946 - RNA, 19 nt, Artificial Sequence
  Description of Artificial Sequence:  synthetic
acggucuaugccauuccuc

SEQ ID NO: 947 - RNA, 19 nt, Artificial Sequence
  Description of Artificial Sequence:  synthetic
cccccgcaucacauccacu

SEQ ID NO: 948 - RNA, 19 nt, Artificial Sequence
  Description of Artificial Sequence:  synthetic
ugguauuggcaguuggagg

SEQ ID NO: 949 - RNA, 19 nt, Artificial Sequence
  Description of Artificial Sequence:  synthetic
gaagagugcgccaacgagc

SEQ ID NO: 950 - RNA, 19 nt, Artificial Sequence
  Description of Artificial Sequence:  synthetic
cccagccaagcugucucag

SEQ ID NO: 951 - RNA, 19 nt, Artificial Sequence
  Description of Artificial Sequence:  synthetic
gugacaaacccauacccuu

SEQ ID NO: 952 - RNA, 19 nt, Artificial Sequence
  Description of Artificial Sequence:  synthetic
ugugaagaauggagaagug

SEQ ID NO: 953 - RNA, 19 nt, Artificial Sequence
  Description of Artificial Sequence:  synthetic
guggaggacuuccagggag

SEQ ID NO: 954 - RNA, 19 nt, Artificial Sequence
  Description of Artificial Sequence:  synthetic
ggaaauaaaauugaaguua

SEQ ID NO: 955 - RNA, 19 nt, Artificial Sequence
  Description of Artificial Sequence:  synthetic
aauaaaaaucaauuugcuc

SEQ ID NO: 956 - RNA, 19 nt, Artificial Sequence
  Description of Artificial Sequence:  synthetic
cuaauugaaggaaaaaaca

SEQ ID NO: 957 - RNA, 19 nt, Artificial Sequence
  Description of Artificial Sequence:  synthetic
aaaacuguaaguacccuug

SEQ ID NO: 958 - RNA, 19 nt, Artificial Sequence
  Description of Artificial Sequence:  synthetic
guuauccaagcggcaaaug

SEQ ID NO: 959 - RNA, 19 nt, Artificial Sequence
  Description of Artificial Sequence:  synthetic
gugucagcuuuguacaaau

SEQ ID NO: 960 - RNA, 19 nt, Artificial Sequence
  Description of Artificial Sequence:  synthetic
ugugaagcggucaacaaag

SEQ ID NO: 961 - RNA, 19 nt, Artificial Sequence
  Description of Artificial Sequence:  synthetic
gucgggagaggagagaggg

SEQ ID NO: 962 - RNA, 19 nt, Artificial Sequence
  Description of Artificial Sequence:  synthetic
gugaucuccuuccacguga

SEQ ID NO: 963 - RNA, 19 nt, Artificial Sequence
  Description of Artificial Sequence:  synthetic
accagggguccugaaauua

SEQ ID NO: 964 - RNA, 19 nt, Artificial Sequence
  Description of Artificial Sequence:  synthetic
acuuugcaaccugacaugc

SEQ ID NO: 965 - RNA, 19 nt, Artificial Sequence
  Description of Artificial Sequence:  synthetic
cagcccacugagcaggaga

SEQ ID NO: 966 - RNA, 19 nt, Artificial Sequence
  Description of Artificial Sequence:  synthetic
agcgugucuuuguggugca

SEQ ID NO: 967 - RNA, 19 nt, Artificial Sequence
  Description of Artificial Sequence:  synthetic
acugcagacagaucuacgu

SEQ ID NO: 968 - RNA, 19 nt, Artificial Sequence
  Description of Artificial Sequence:  synthetic
uuugagaaccucacauggu

SEQ ID NO: 969 - RNA, 19 nt, Artificial Sequence
  Description of Artificial Sequence:  synthetic
uacaagcuuggcccacagc

SEQ ID NO: 970 - RNA, 19 nt, Artificial Sequence
  Description of Artificial Sequence:  synthetic
ccucugccaauccaugugg

SEQ ID NO: 971 - RNA, 19 nt, Artificial Sequence
  Description of Artificial Sequence:  synthetic
ggagaguugcccacaccug

SEQ ID NO: 972 - RNA, 19 nt, Artificial Sequence
  Description of Artificial Sequence:  synthetic
guuugcaagaacuuggaua

SEQ ID NO: 973 - RNA, 19 nt, Artificial Sequence
  Description of Artificial Sequence:  synthetic
acucuuuggaaauugaaug

SEQ ID NO: 974 - RNA, 19 nt, Artificial Sequence
  Description of Artificial Sequence:  synthetic
gccaccauguucucuaaua

SEQ ID NO: 975 - RNA, 19 nt, Artificial Sequence
  Description of Artificial Sequence:  synthetic
agcacaaaugacauuuuga

SEQ ID NO: 976 - RNA, 19 nt, Artificial Sequence
  Description of Artificial Sequence:  synthetic
aucauggagcuuaagaaug

SEQ ID NO: 977 - RNA, 19 nt, Artificial Sequence
  Description of Artificial Sequence:  synthetic
gcauccuugcaggaccaag

SEQ ID NO: 978 - RNA, 19 nt, Artificial Sequence
  Description of Artificial Sequence:  synthetic
ggagacuaugucugccuug

SEQ ID NO: 979 - RNA, 19 nt, Artificial Sequence
  Description of Artificial Sequence:  synthetic
gcucaagacaggaagacca

SEQ ID NO: 980 - RNA, 19 nt, Artificial Sequence
  Description of Artificial Sequence:  synthetic
aagaaaagacauugcgugg

SEQ ID NO: 981 - RNA, 19 nt, Artificial Sequence
  Description of Artificial Sequence:  synthetic
gucaggcagcucacagucc

SEQ ID NO: 982 - RNA, 19 nt, Artificial Sequence
  Description of Artificial Sequence:  synthetic
cuagagcguguggcaccca

SEQ ID NO: 983 - RNA, 19 nt, Artificial Sequence
  Description of Artificial Sequence:  synthetic
acgaucacaggaaaccugg

SEQ ID NO: 984 - RNA, 19 nt, Artificial Sequence
  Description of Artificial Sequence:  synthetic
gagaaucagacgacaagua

SEQ ID NO: 985 - RNA, 19 nt, Artificial Sequence
  Description of Artificial Sequence:  synthetic
auuggggaaagcaucgaag

SEQ ID NO: 986 - RNA, 19 nt, Artificial Sequence
  Description of Artificial Sequence:  synthetic
gucucaugcacggcaucug

SEQ ID NO: 987 - RNA, 19 nt, Artificial Sequence
  Description of Artificial Sequence:  synthetic
gggaaucccccuccacaga

SEQ ID NO: 988 - RNA, 19 nt, Artificial Sequence
  Description of Artificial Sequence:  synthetic
aucaugugguuuaaagaua

SEQ ID NO: 989 - RNA, 19 nt, Artificial Sequence
  Description of Artificial Sequence:  synthetic
aaugagacccuuguagaag

SEQ ID NO: 990 - RNA, 19 nt, Artificial Sequence
  Description of Artificial Sequence:  synthetic
gacucaggcauuguauuga

SEQ ID NO: 991 - RNA, 19 nt, Artificial Sequence
  Description of Artificial Sequence:  synthetic
aaggaugggaaccggaacc

SEQ ID NO: 992 - RNA, 19 nt, Artificial Sequence
  Description of Artificial Sequence:  synthetic
cucacuauccgcagaguga

SEQ ID NO: 993 - RNA, 19 nt, Artificial Sequence
  Description of Artificial Sequence:  synthetic
aggaaggaggacgaaggcc

SEQ ID NO: 994 - RNA, 19 nt, Artificial Sequence
  Description of Artificial Sequence:  synthetic
cucuacaccugccaggcau

SEQ ID NO: 995 - RNA, 19 nt, Artificial Sequence
  Description of Artificial Sequence:  synthetic
ugcaguguucuuggcugug

SEQ ID NO: 996 - RNA, 19 nt, Artificial Sequence
  Description of Artificial Sequence:  synthetic
gcaaaaguggaggcauuuu

SEQ ID NO: 997 - RNA, 19 nt, Artificial Sequence
  Description of Artificial Sequence:  synthetic
uucauaauagaaggugccc

SEQ ID NO: 998 - RNA, 19 nt, Artificial Sequence
  Description of Artificial Sequence:  synthetic
caggaaaagacgaacuugg

SEQ ID NO: 999 - RNA, 19 nt, Artificial Sequence
  Description of Artificial Sequence:  synthetic
gaaaucauuauucuaguag

SEQ ID NO: 1000 - RNA, 19 nt, Artificial Sequence
  Description of Artificial Sequence:  synthetic
ggcacggcggugauugcca

SEQ ID NO: 1001 - RNA, 19 nt, Artificial Sequence
  Description of Artificial Sequence:  synthetic
auguucuucuggcuacuuc

SEQ ID NO: 1002 - RNA, 19 nt, Artificial Sequence
  Description of Artificial Sequence:  synthetic
cuugucaucauccuacgga

SEQ ID NO: 1003 - RNA, 19 nt, Artificial Sequence
  Description of Artificial Sequence:  synthetic
accguuaagcgggccaaug

SEQ ID NO: 1004 - RNA, 19 nt, Artificial Sequence
  Description of Artificial Sequence:  synthetic
ggaggggaacugaagacag

SEQ ID NO: 1005 - RNA, 19 nt, Artificial Sequence
  Description of Artificial Sequence:  synthetic
ggcuacuuguccaucguca

SEQ ID NO: 1006 - RNA, 19 nt, Artificial Sequence
  Description of Artificial Sequence:  synthetic
auggauccagaugaacucc

SEQ ID NO: 1007 - RNA, 19 nt, Artificial Sequence
  Description of Artificial Sequence:  synthetic
ccauuggaugaacauugug

SEQ ID NO: 1008 - RNA, 19 nt, Artificial Sequence
  Description of Artificial Sequence:  synthetic
gaacgacugccuuaugaug

SEQ ID NO: 1009 - RNA, 19 nt, Artificial Sequence
  Description of Artificial Sequence:  synthetic
gccagcaaaugggaauucc

SEQ ID NO: 1010 - RNA, 19 nt, Artificial Sequence
  Description of Artificial Sequence:  synthetic
cccagagaccggcugaagc

SEQ ID NO: 1011 - RNA, 19 nt, Artificial Sequence
  Description of Artificial Sequence:  synthetic
cuagguaagccucuuggcc

SEQ ID NO: 1012 - RNA, 19 nt, Artificial Sequence
  Description of Artificial Sequence:  synthetic
cguggugccuuuggccaag

SEQ ID NO: 1013 - RNA, 19 nt, Artificial Sequence
  Description of Artificial Sequence:  synthetic
gugauugaagcagaugccu

SEQ ID NO: 1014 - RNA, 19 nt, Artificial Sequence
  Description of Artificial Sequence:  synthetic
uuuggaauugacaagacag

SEQ ID NO: 1015 - RNA, 19 nt, Artificial Sequence
  Description of Artificial Sequence:  synthetic
gcaacuugcaggacaguag

SEQ ID NO: 1016 - RNA, 19 nt, Artificial Sequence
  Description of Artificial Sequence:  synthetic
gcagucaaaauguugaaag

SEQ ID NO: 1017 - RNA, 19 nt, Artificial Sequence
  Description of Artificial Sequence:  synthetic
gaaggagcaacacacagug

SEQ ID NO: 1018 - RNA, 19 nt, Artificial Sequence
  Description of Artificial Sequence:  synthetic
gagcaucgagcucucaugu

SEQ ID NO: 1019 - RNA, 19 nt, Artificial Sequence
  Description of Artificial Sequence:  synthetic
ucugaacucaagauccuca

SEQ ID NO: 1020 - RNA, 19 nt, Artificial Sequence
  Description of Artificial Sequence:  synthetic
auucauauuggucaccauc

SEQ ID NO: 1021 - RNA, 19 nt, Artificial Sequence
  Description of Artificial Sequence:  synthetic
cucaauguggucaaccuuc

SEQ ID NO: 1022 - RNA, 19 nt, Artificial Sequence
  Description of Artificial Sequence:  synthetic
cuaggugccuguaccaagc

SEQ ID NO: 1023 - RNA, 19 nt, Artificial Sequence
  Description of Artificial Sequence:  synthetic
ccaggagggccacucaugg

SEQ ID NO: 1024 - RNA, 19 nt, Artificial Sequence
  Description of Artificial Sequence:  synthetic
gugauuguggaauucugca

SEQ ID NO: 1025 - RNA, 19 nt, Artificial Sequence
  Description of Artificial Sequence:  synthetic
aaauuuggaaaccugucca

SEQ ID NO: 1026 - RNA, 19 nt, Artificial Sequence
  Description of Artificial Sequence:  synthetic
acuuaccugaggagcaaga

SEQ ID NO: 1027 - RNA, 19 nt, Artificial Sequence
  Description of Artificial Sequence:  synthetic
agaaaugaauuuguccccu

SEQ ID NO: 1028 - RNA, 19 nt, Artificial Sequence
  Description of Artificial Sequence:  synthetic
uacaagaccaaaggggcac

SEQ ID NO: 1029 - RNA, 19 nt, Artificial Sequence
  Description of Artificial Sequence:  synthetic
cgauuccgucaagggaaag

SEQ ID NO: 1030 - RNA, 19 nt, Artificial Sequence
  Description of Artificial Sequence:  synthetic
gacuacguuggagcaaucc

SEQ ID NO: 1031 - RNA, 19 nt, Artificial Sequence
  Description of Artificial Sequence:  synthetic
ccuguggaucugaaacggc

SEQ ID NO: 1032 - RNA, 19 nt, Artificial Sequence
  Description of Artificial Sequence:  synthetic
cgcuuggacagcaucacca

SEQ ID NO: 1033 - RNA, 19 nt, Artificial Sequence
  Description of Artificial Sequence:  synthetic
aguagccagagcucagcca

SEQ ID NO: 1034 - RNA, 19 nt, Artificial Sequence
  Description of Artificial Sequence:  synthetic
agcucuggauuuguggagg

SEQ ID NO: 1035 - RNA, 19 nt, Artificial Sequence
  Description of Artificial Sequence:  synthetic
gagaagucccucagugaug

SEQ ID NO: 1036 - RNA, 19 nt, Artificial Sequence
  Description of Artificial Sequence:  synthetic
guagaagaagaggaagcuc

SEQ ID NO: 1037 - RNA, 19 nt, Artificial Sequence
  Description of Artificial Sequence:  synthetic
ccugaagaucuguauaagg

SEQ ID NO: 1038 - RNA, 19 nt, Artificial Sequence
  Description of Artificial Sequence:  synthetic
gacuuccugaccuuggagc

SEQ ID NO: 1039 - RNA, 19 nt, Artificial Sequence
  Description of Artificial Sequence:  synthetic
caucucaucuguuacagcu

SEQ ID NO: 1040 - RNA, 19 nt, Artificial Sequence
  Description of Artificial Sequence:  synthetic
uuccaaguggcuaagggca

SEQ ID NO: 1041 - RNA, 19 nt, Artificial Sequence
  Description of Artificial Sequence:  synthetic
auggaguucuuggcaucgc

SEQ ID NO: 1042 - RNA, 19 nt, Artificial Sequence
  Description of Artificial Sequence:  synthetic
cgaaaguguauccacaggg

SEQ ID NO: 1043 - RNA, 19 nt, Artificial Sequence
  Description of Artificial Sequence:  synthetic
gaccuggcggcacgaaaua

SEQ ID NO: 1044 - RNA, 19 nt, Artificial Sequence
  Description of Artificial Sequence:  synthetic
auccucuuaucggagaaga

SEQ ID NO: 1045 - RNA, 19 nt, Artificial Sequence
  Description of Artificial Sequence:  synthetic
aacgugguuaaaaucugug

SEQ ID NO: 1046 - RNA, 19 nt, Artificial Sequence
  Description of Artificial Sequence:  synthetic
gacuuuggcuuggcccggg

SEQ ID NO: 1047 - RNA, 19 nt, Artificial Sequence
  Description of Artificial Sequence:  synthetic
gauauuuauaaagauccag

SEQ ID NO: 1048 - RNA, 19 nt, Artificial Sequence
  Description of Artificial Sequence:  synthetic
gauuaugucagaaaaggag

SEQ ID NO: 1049 - RNA, 19 nt, Artificial Sequence
  Description of Artificial Sequence:  synthetic
gaugcucgccucccuuuga

SEQ ID NO: 1050 - RNA, 19 nt, Artificial Sequence
  Description of Artificial Sequence:  synthetic
aaauggauggccccagaaa

SEQ ID NO: 1051 - RNA, 19 nt, Artificial Sequence
  Description of Artificial Sequence:  synthetic
acaauuuuugacagagugu

SEQ ID NO: 1052 - RNA, 19 nt, Artificial Sequence
  Description of Artificial Sequence:  synthetic
uacacaauccagagugacg

SEQ ID NO: 1053 - RNA, 19 nt, Artificial Sequence
  Description of Artificial Sequence:  synthetic
gucuggucuuuugguguuu

SEQ ID NO: 1054 - RNA, 19 nt, Artificial Sequence
  Description of Artificial Sequence:  synthetic
uugcugugggaaauauuuu

SEQ ID NO: 1055 - RNA, 19 nt, Artificial Sequence
  Description of Artificial Sequence:  synthetic
uccuuaggugcuucuccau

SEQ ID NO: 1056 - RNA, 19 nt, Artificial Sequence
  Description of Artificial Sequence:  synthetic
uauccugggguaaagauug

SEQ ID NO: 1057 - RNA, 19 nt, Artificial Sequence
  Description of Artificial Sequence:  synthetic
gaugaagaauuuuguaggc

SEQ ID NO: 1058 - RNA, 19 nt, Artificial Sequence
  Description of Artificial Sequence:  synthetic
cgauugaaagaaggaacua

SEQ ID NO: 1059 - RNA, 19 nt, Artificial Sequence
  Description of Artificial Sequence:  synthetic
agaaugagggccccugauu

SEQ ID NO: 1060 - RNA, 19 nt, Artificial Sequence
  Description of Artificial Sequence:  synthetic
uauacuacaccagaaaugu

SEQ ID NO: 1061 - RNA, 19 nt, Artificial Sequence
  Description of Artificial Sequence:  synthetic
uaccagaccaugcuggacu

SEQ ID NO: 1062 - RNA, 19 nt, Artificial Sequence
  Description of Artificial Sequence:  synthetic
ugcuggcacggggagccca

SEQ ID NO: 1063 - RNA, 19 nt, Artificial Sequence
  Description of Artificial Sequence:  synthetic
agucagagacccacguuuu

SEQ ID NO: 1064 - RNA, 19 nt, Artificial Sequence
  Description of Artificial Sequence:  synthetic
ucagaguugguggaacauu

SEQ ID NO: 1065 - RNA, 19 nt, Artificial Sequence
  Description of Artificial Sequence:  synthetic
uugggaaaucucuugcaag

SEQ ID NO: 1066 - RNA, 19 nt, Artificial Sequence
  Description of Artificial Sequence:  synthetic
gcuaaugcucagcaggaug

SEQ ID NO: 1067 - RNA, 19 nt, Artificial Sequence
  Description of Artificial Sequence:  synthetic
ggcaaagacuacauuguuc

SEQ ID NO: 1068 - RNA, 19 nt, Artificial Sequence
  Description of Artificial Sequence:  synthetic
cuuccgauaucagagacuu

SEQ ID NO: 1069 - RNA, 19 nt, Artificial Sequence
  Description of Artificial Sequence:  synthetic
uugagcauggaagaggauu

SEQ ID NO: 1070 - RNA, 19 nt, Artificial Sequence
  Description of Artificial Sequence:  synthetic
ucuggacucucucugccua

SEQ ID NO: 1071 - RNA, 19 nt, Artificial Sequence
  Description of Artificial Sequence:  synthetic
accucaccuguuuccugua

SEQ ID NO: 1072 - RNA, 19 nt, Artificial Sequence
  Description of Artificial Sequence:  synthetic
auggaggaggaggaaguau

SEQ ID NO: 1073 - RNA, 19 nt, Artificial Sequence
  Description of Artificial Sequence:  synthetic
ugugaccccaaauuccauu

SEQ ID NO: 1074 - RNA, 19 nt, Artificial Sequence
  Description of Artificial Sequence:  synthetic
uaugacaacacagcaggaa

SEQ ID NO: 1075 - RNA, 19 nt, Artificial Sequence
  Description of Artificial Sequence:  synthetic
aucagucaguaucugcaga

SEQ ID NO: 1076 - RNA, 19 nt, Artificial Sequence
  Description of Artificial Sequence:  synthetic
aacaguaagcgaaagagcc

SEQ ID NO: 1077 - RNA, 19 nt, Artificial Sequence
  Description of Artificial Sequence:  synthetic
cggccugugaguguaaaaa

SEQ ID NO: 1078 - RNA, 19 nt, Artificial Sequence
  Description of Artificial Sequence:  synthetic
acauuugaagauaucccgu

SEQ ID NO: 1079 - RNA, 19 nt, Artificial Sequence
  Description of Artificial Sequence:  synthetic
uuagaagaaccagaaguaa

SEQ ID NO: 1080 - RNA, 19 nt, Artificial Sequence
  Description of Artificial Sequence:  synthetic
aaaguaaucccagaugaca

SEQ ID NO: 1081 - RNA, 19 nt, Artificial Sequence
  Description of Artificial Sequence:  synthetic
aaccagacggacaguggua

SEQ ID NO: 1082 - RNA, 19 nt, Artificial Sequence
  Description of Artificial Sequence:  synthetic
augguucuugccucagaag

SEQ ID NO: 1083 - RNA, 19 nt, Artificial Sequence
  Description of Artificial Sequence:  synthetic
gagcugaaaacuuuggaag

SEQ ID NO: 1084 - RNA, 19 nt, Artificial Sequence
  Description of Artificial Sequence:  synthetic
gacagaaccaaauuaucuc

SEQ ID NO: 1085 - RNA, 19 nt, Artificial Sequence
  Description of Artificial Sequence:  synthetic
ccaucuuuugguggaaugg

SEQ ID NO: 1086 - RNA, 19 nt, Artificial Sequence
  Description of Artificial Sequence:  synthetic
gugcccagcaaaagcaggg

SEQ ID NO: 1087 - RNA, 19 nt, Artificial Sequence
  Description of Artificial Sequence:  synthetic
gagucuguggcaucugaag

SEQ ID NO: 1088 - RNA, 19 nt, Artificial Sequence
  Description of Artificial Sequence:  synthetic
ggcucaaaccagacaagcg

SEQ ID NO: 1089 - RNA, 19 nt, Artificial Sequence
  Description of Artificial Sequence:  synthetic
ggcuaccaguccggauauc

SEQ ID NO: 1090 - RNA, 19 nt, Artificial Sequence
  Description of Artificial Sequence:  synthetic
cacuccgaugacacagaca

SEQ ID NO: 1091 - RNA, 19 nt, Artificial Sequence
  Description of Artificial Sequence:  synthetic
accaccguguacuccagug

SEQ ID NO: 1092 - RNA, 19 nt, Artificial Sequence
  Description of Artificial Sequence:  synthetic
gaggaagcagaacuuuuaa

SEQ ID NO: 1093 - RNA, 19 nt, Artificial Sequence
  Description of Artificial Sequence:  synthetic
aagcugauagagauuggag

SEQ ID NO: 1094 - RNA, 19 nt, Artificial Sequence
  Description of Artificial Sequence:  synthetic
gugcaaaccgguagcacag

SEQ ID NO: 1095 - RNA, 19 nt, Artificial Sequence
  Description of Artificial Sequence:  synthetic
gcccagauucuccagccug

SEQ ID NO: 1096 - RNA, 19 nt, Artificial Sequence
  Description of Artificial Sequence:  synthetic
gacucggggaccacacuga

SEQ ID NO: 1097 - RNA, 19 nt, Artificial Sequence
  Description of Artificial Sequence:  synthetic
agcucuccuccuguuuaaa

SEQ ID NO: 1098 - RNA, 19 nt, Artificial Sequence
  Description of Artificial Sequence:  synthetic
aaggaagcauccacacccc

SEQ ID NO: 1099 - RNA, 19 nt, Artificial Sequence
  Description of Artificial Sequence:  synthetic
caacucccggacaucacau

SEQ ID NO: 1100 - RNA, 19 nt, Artificial Sequence
  Description of Artificial Sequence:  synthetic
ugagaggucugcucagauu

SEQ ID NO: 1101 - RNA, 19 nt, Artificial Sequence
  Description of Artificial Sequence:  synthetic
uuugaaguguuguucuuuc

SEQ ID NO: 1102 - RNA, 19 nt, Artificial Sequence
  Description of Artificial Sequence:  synthetic
ccaccagcaggaaguagcc

SEQ ID NO: 1103 - RNA, 19 nt, Artificial Sequence
  Description of Artificial Sequence:  synthetic
cgcauuugauuuucauuuc

SEQ ID NO: 1104 - RNA, 19 nt, Artificial Sequence
  Description of Artificial Sequence:  synthetic
cgacaacagaaaaaggacc

SEQ ID NO: 1105 - RNA, 19 nt, Artificial Sequence
  Description of Artificial Sequence:  synthetic
cucggacugcagggagcca

SEQ ID NO: 1106 - RNA, 19 nt, Artificial Sequence
  Description of Artificial Sequence:  synthetic
agucuucuaggcauauccu

SEQ ID NO: 1107 - RNA, 19 nt, Artificial Sequence
  Description of Artificial Sequence:  synthetic
uggaagaggcuugugaccc

SEQ ID NO: 1108 - RNA, 19 nt, Artificial Sequence
  Description of Artificial Sequence:  synthetic
caagaaugugucugugucu

SEQ ID NO: 1109 - RNA, 19 nt, Artificial Sequence
  Description of Artificial Sequence:  synthetic
uucucccaguguugaccug

SEQ ID NO: 1110 - RNA, 19 nt, Artificial Sequence
  Description of Artificial Sequence:  synthetic
gauccucuuuuuucauuca

SEQ ID NO: 1111 - RNA, 19 nt, Artificial Sequence
  Description of Artificial Sequence:  synthetic
auuuaaaaagcauuaucau

SEQ ID NO: 1112 - RNA, 19 nt, Artificial Sequence
  Description of Artificial Sequence:  synthetic
ugccccugcugcgggucuc

SEQ ID NO: 1113 - RNA, 19 nt, Artificial Sequence
  Description of Artificial Sequence:  synthetic
caccauggguuuagaacaa

SEQ ID NO: 1114 - RNA, 19 nt, Artificial Sequence
  Description of Artificial Sequence:  synthetic
aagagcuucaagcaauggc

SEQ ID NO: 1115 - RNA, 19 nt, Artificial Sequence
  Description of Artificial Sequence:  synthetic
ccccauccucaaagaagua

SEQ ID NO: 1116 - RNA, 19 nt, Artificial Sequence
  Description of Artificial Sequence:  synthetic
agcaguaccuggggagcug

SEQ ID NO: 1117 - RNA, 19 nt, Artificial Sequence
  Description of Artificial Sequence:  synthetic
gacacuucuguaaaacuag

SEQ ID NO: 1118 - RNA, 19 nt, Artificial Sequence
  Description of Artificial Sequence:  synthetic
gaagauaaaccaggcaacg

SEQ ID NO: 1119 - RNA, 19 nt, Artificial Sequence
  Description of Artificial Sequence:  synthetic
guaaguguucgagguguug

SEQ ID NO: 1120 - RNA, 19 nt, Artificial Sequence
  Description of Artificial Sequence:  synthetic
gaagaugggaaggauuugc

SEQ ID NO: 1121 - RNA, 19 nt, Artificial Sequence
  Description of Artificial Sequence:  synthetic
cagggcugagucuauccaa

SEQ ID NO: 1122 - RNA, 19 nt, Artificial Sequence
  Description of Artificial Sequence:  synthetic
agaggcuuuguuuaggacg

SEQ ID NO: 1123 - RNA, 19 nt, Artificial Sequence
  Description of Artificial Sequence:  synthetic
gugggucccaagccaagcc

SEQ ID NO: 1124 - RNA, 19 nt, Artificial Sequence
  Description of Artificial Sequence:  synthetic
cuuaaguguggaauucgga

SEQ ID NO: 1125 - RNA, 19 nt, Artificial Sequence
  Description of Artificial Sequence:  synthetic
auugauagaaaggaagacu

SEQ ID NO: 1126 - RNA, 19 nt, Artificial Sequence
  Description of Artificial Sequence:  synthetic
uaacguuaccuugcuuugg

SEQ ID NO: 1127 - RNA, 19 nt, Artificial Sequence
  Description of Artificial Sequence:  synthetic
gagaguacuggagccugca

SEQ ID NO: 1128 - RNA, 19 nt, Artificial Sequence
  Description of Artificial Sequence:  synthetic
aaaugcauuguguuugcuc

SEQ ID NO: 1129 - RNA, 19 nt, Artificial Sequence
  Description of Artificial Sequence:  synthetic
cugguggaggugggcaugg

SEQ ID NO: 1130 - RNA, 19 nt, Artificial Sequence
  Description of Artificial Sequence:  synthetic
gggucuguucugaaaugua

SEQ ID NO: 1131 - RNA, 19 nt, Artificial Sequence
  Description of Artificial Sequence:  synthetic
aaaggguucagacgggguu

SEQ ID NO: 1132 - RNA, 19 nt, Artificial Sequence
  Description of Artificial Sequence:  synthetic
uucugguuuuagaagguug

SEQ ID NO: 1133 - RNA, 19 nt, Artificial Sequence
  Description of Artificial Sequence:  synthetic
gcguguucuucgaguuggg

SEQ ID NO: 1134 - RNA, 19 nt, Artificial Sequence
  Description of Artificial Sequence:  synthetic
gcuaaaguagaguucguug

SEQ ID NO: 1135 - RNA, 19 nt, Artificial Sequence
  Description of Artificial Sequence:  synthetic
gugcuguuucugacuccua

SEQ ID NO: 1136 - RNA, 19 nt, Artificial Sequence
  Description of Artificial Sequence:  synthetic
aaugagaguuccuuccaga

SEQ ID NO: 1137 - RNA, 19 nt, Artificial Sequence
  Description of Artificial Sequence:  synthetic
accguuagcugucuccuug

SEQ ID NO: 1138 - RNA, 19 nt, Artificial Sequence
  Description of Artificial Sequence:  synthetic
gccaagccccaggaagaaa

SEQ ID NO: 1139 - RNA, 19 nt, Artificial Sequence
  Description of Artificial Sequence:  synthetic
aaugaugcagcucuggcuc

SEQ ID NO: 1140 - RNA, 19 nt, Artificial Sequence
  Description of Artificial Sequence:  synthetic
ccuugucucccaggcugau

SEQ ID NO: 1141 - RNA, 19 nt, Artificial Sequence
  Description of Artificial Sequence:  synthetic
uccuuuauucagaauacca

SEQ ID NO: 1142 - RNA, 19 nt, Artificial Sequence
  Description of Artificial Sequence:  synthetic
acaaagaaaggacauucag

SEQ ID NO: 1143 - RNA, 19 nt, Artificial Sequence
  Description of Artificial Sequence:  synthetic
gcucaaggcucccugccgu

SEQ ID NO: 1144 - RNA, 19 nt, Artificial Sequence
  Description of Artificial Sequence:  synthetic
uguugaagaguucugacug

SEQ ID NO: 1145 - RNA, 19 nt, Artificial Sequence
  Description of Artificial Sequence:  synthetic
gcacaaaccagcuucuggu

SEQ ID NO: 1146 - RNA, 19 nt, Artificial Sequence
  Description of Artificial Sequence:  synthetic
uuucuucuggaaugaauac

SEQ ID NO: 1147 - RNA, 19 nt, Artificial Sequence
  Description of Artificial Sequence:  synthetic
cccucauaucuguccugau

SEQ ID NO: 1148 - RNA, 19 nt, Artificial Sequence
  Description of Artificial Sequence:  synthetic
ugugauaugucugagacug

SEQ ID NO: 1149 - RNA, 19 nt, Artificial Sequence
  Description of Artificial Sequence:  synthetic
gaaugcgggagguucaaug

SEQ ID NO: 1150 - RNA, 19 nt, Artificial Sequence
  Description of Artificial Sequence:  synthetic
gugaagcuguguguggugu

SEQ ID NO: 1151 - RNA, 19 nt, Artificial Sequence
  Description of Artificial Sequence:  synthetic
ucaaaguuucaggaaggau

SEQ ID NO: 1152 - RNA, 19 nt, Artificial Sequence
  Description of Artificial Sequence:  synthetic
uuuuacccuuuuguucuuc

SEQ ID NO: 1153 - RNA, 19 nt, Artificial Sequence
  Description of Artificial Sequence:  synthetic
cccccuguccccaacccac

SEQ ID NO: 1154 - RNA, 19 nt, Artificial Sequence
  Description of Artificial Sequence:  synthetic
cucucaccccgcaacccau

SEQ ID NO: 1155 - RNA, 19 nt, Artificial Sequence
  Description of Artificial Sequence:  synthetic
ucaguauuuuaguuauuug

SEQ ID NO: 1156 - RNA, 19 nt, Artificial Sequence
  Description of Artificial Sequence:  synthetic
ggccucuacuccaguaaac

SEQ ID NO: 1157 - RNA, 19 nt, Artificial Sequence
  Description of Artificial Sequence:  synthetic
ccugauuggguuuguucac

SEQ ID NO: 1158 - RNA, 19 nt, Artificial Sequence
  Description of Artificial Sequence:  synthetic
cucucugaaugauuauuag

SEQ ID NO: 1159 - RNA, 19 nt, Artificial Sequence
  Description of Artificial Sequence:  synthetic
gccagacuucaaaauuauu

SEQ ID NO: 1160 - RNA, 19 nt, Artificial Sequence
  Description of Artificial Sequence:  synthetic
uuuauagcccaaauuauaa

SEQ ID NO: 1161 - RNA, 19 nt, Artificial Sequence
  Description of Artificial Sequence:  synthetic
acaucuauuguauuauuua

SEQ ID NO: 1162 - RNA, 19 nt, Artificial Sequence
  Description of Artificial Sequence:  synthetic
agacuuuuaacauauagag

SEQ ID NO: 1163 - RNA, 19 nt, Artificial Sequence
  Description of Artificial Sequence:  synthetic
gcuauuucuacugauuuuu

SEQ ID NO: 1164 - RNA, 19 nt, Artificial Sequence
  Description of Artificial Sequence:  synthetic
ugcccuuguucuguccuuu

SEQ ID NO: 1165 - RNA, 19 nt, Artificial Sequence
  Description of Artificial Sequence:  synthetic
uuuuucaaaaaagaaaaug

SEQ ID NO: 1166 - RNA, 19 nt, Artificial Sequence
  Description of Artificial Sequence:  synthetic
guguuuuuuguuugguacc

SEQ ID NO: 1167 - RNA, 19 nt, Artificial Sequence
  Description of Artificial Sequence:  synthetic
cauagugugaaaugcuggg

SEQ ID NO: 1168 - RNA, 19 nt, Artificial Sequence
  Description of Artificial Sequence:  synthetic
gaacaaugacuauaagaca

SEQ ID NO: 1169 - RNA, 19 nt, Artificial Sequence
  Description of Artificial Sequence:  synthetic
augcuauggcacauauauu

SEQ ID NO: 1170 - RNA, 19 nt, Artificial Sequence
  Description of Artificial Sequence:  synthetic
uuauagucuguuuauguag

SEQ ID NO: 1171 - RNA, 19 nt, Artificial Sequence
  Description of Artificial Sequence:  synthetic
gaaacaaauguaauauauu

SEQ ID NO: 1172 - RNA, 19 nt, Artificial Sequence
  Description of Artificial Sequence:  synthetic
uaaagccuuauauauaaug

SEQ ID NO: 1173 - RNA, 19 nt, Artificial Sequence
  Description of Artificial Sequence:  synthetic
gaacuuuguacuauucaca

SEQ ID NO: 1174 - RNA, 19 nt, Artificial Sequence
  Description of Artificial Sequence:  synthetic
auuuuguaucaguauuaug

SEQ ID NO: 1175 - RNA, 19 nt, Artificial Sequence
  Description of Artificial Sequence:  synthetic
guagcauaacaaaggucau

SEQ ID NO: 1176 - RNA, 19 nt, Artificial Sequence
  Description of Artificial Sequence:  synthetic
uaaugcuuucagcaauuga

SEQ ID NO: 1177 - RNA, 19 nt, Artificial Sequence
  Description of Artificial Sequence:  synthetic
augucauuuuauuaaagaa

SEQ ID NO: 1178 - RNA, 19 nt, Artificial Sequence
  Description of Artificial Sequence:  synthetic
agaacauugaaaaacuuga

SEQ ID NO: 1179 - RNA, 19 nt, Artificial Sequence
  Description of Artificial Sequence:  synthetic
cggggucccgggacucagu

SEQ ID NO: 1180 - RNA, 19 nt, Artificial Sequence
  Description of Artificial Sequence:  synthetic
acacacugaccgcucuccc

SEQ ID NO: 1181 - RNA, 19 nt, Artificial Sequence
  Description of Artificial Sequence:  synthetic
agaggaaacgcagcgacca

SEQ ID NO: 1182 - RNA, 19 nt, Artificial Sequence
  Description of Artificial Sequence:  synthetic
gugaugcccggcgcaggca

SEQ ID NO: 1183 - RNA, 19 nt, Artificial Sequence
  Description of Artificial Sequence:  synthetic
acuuucugcggcgcgcaag

SEQ ID NO: 1184 - RNA, 19 nt, Artificial Sequence
  Description of Artificial Sequence:  synthetic
auccaggcugccagacgga

SEQ ID NO: 1185 - RNA, 19 nt, Artificial Sequence
  Description of Artificial Sequence:  synthetic
gugccgguaggagaggaua

SEQ ID NO: 1186 - RNA, 19 nt, Artificial Sequence
  Description of Artificial Sequence:  synthetic
cugcaggggcgucugcggg

SEQ ID NO: 1187 - RNA, 19 nt, Artificial Sequence
  Description of Artificial Sequence:  synthetic
ccgggcgccgaccggcggc

SEQ ID NO: 1188 - RNA, 19 nt, Artificial Sequence
  Description of Artificial Sequence:  synthetic
cgcacagggcuagggagcc

SEQ ID NO: 1189 - RNA, 19 nt, Artificial Sequence
  Description of Artificial Sequence:  synthetic
cagcgcaggacaguugagc

SEQ ID NO: 1190 - RNA, 19 nt, Artificial Sequence
  Description of Artificial Sequence:  synthetic
ggaacucgcggcaccccgc

SEQ ID NO: 1191 - RNA, 19 nt, Artificial Sequence
  Description of Artificial Sequence:  synthetic
agaaggaggcgcggaggug

SEQ ID NO: 1192 - RNA, 19 nt, Artificial Sequence
  Description of Artificial Sequence:  synthetic
cucccagcgccugucuaga

SEQ ID NO: 1193 - RNA, 19 nt, Artificial Sequence
  Description of Artificial Sequence:  synthetic
cucgggagccgguucuuuc

SEQ ID NO: 1194 - RNA, 19 nt, Artificial Sequence
  Description of Artificial Sequence:  synthetic
cgggcgaaaugcccagaac

SEQ ID NO: 1195 - RNA, 19 nt, Artificial Sequence
  Description of Artificial Sequence:  synthetic
gcauccugcaccucgagcc

SEQ ID NO: 1196 - RNA, 19 nt, Artificial Sequence
  Description of Artificial Sequence:  synthetic
ccagcagcaccuugcucug

SEQ ID NO: 1197 - RNA, 19 nt, Artificial Sequence
  Description of Artificial Sequence:  synthetic
agagccacagggcgacggc

SEQ ID NO: 1198 - RNA, 19 nt, Artificial Sequence
  Description of Artificial Sequence:  synthetic
cggcccgggucuccacgca

SEQ ID NO: 1199 - RNA, 19 nt, Artificial Sequence
  Description of Artificial Sequence:  synthetic
uaggcaaacccacagaggc

SEQ ID NO: 1200 - RNA, 19 nt, Artificial Sequence
  Description of Artificial Sequence:  synthetic
gcagaucaagagaaacacu

SEQ ID NO: 1201 - RNA, 19 nt, Artificial Sequence
  Description of Artificial Sequence:  synthetic
uuuguaugcugagccuggg

SEQ ID NO: 1202 - RNA, 19 nt, Artificial Sequence
  Description of Artificial Sequence:  synthetic
uaauuguaaguaugucuuu

SEQ ID NO: 1203 - RNA, 19 nt, Artificial Sequence
  Description of Artificial Sequence:  synthetic
gaagaguuguauuagccuu

SEQ ID NO: 1204 - RNA, 19 nt, Artificial Sequence
  Description of Artificial Sequence:  synthetic
guccccugcaaguaauuug

SEQ ID NO: 1205 - RNA, 19 nt, Artificial Sequence
  Description of Artificial Sequence:  synthetic
gccaguccaagucccucug

SEQ ID NO: 1206 - RNA, 19 nt, Artificial Sequence
  Description of Artificial Sequence:  synthetic
ucugauuauugggccaaag

SEQ ID NO: 1207 - RNA, 19 nt, Artificial Sequence
  Description of Artificial Sequence:  synthetic
cccuuugcucacugccacu

SEQ ID NO: 1208 - RNA, 19 nt, Artificial Sequence
  Description of Artificial Sequence:  synthetic
ugcacucagucaccuccac

SEQ ID NO: 1209 - RNA, 19 nt, Artificial Sequence
  Description of Artificial Sequence:  synthetic
uacagaagaggccaucgcu

SEQ ID NO: 1210 - RNA, 19 nt, Artificial Sequence
  Description of Artificial Sequence:  synthetic
uuggaauugugagugucuu

SEQ ID NO: 1211 - RNA, 19 nt, Artificial Sequence
  Description of Artificial Sequence:  synthetic
ugucauuuccgaucacuuu

SEQ ID NO: 1212 - RNA, 19 nt, Artificial Sequence
  Description of Artificial Sequence:  synthetic
agcacuuguaggcuccagu

SEQ ID NO: 1213 - RNA, 19 nt, Artificial Sequence
  Description of Artificial Sequence:  synthetic
agucaguuucccgguagaa

SEQ ID NO: 1214 - RNA, 19 nt, Artificial Sequence
  Description of Artificial Sequence:  synthetic
cauaaaugaccgaggccaa

SEQ ID NO: 1215 - RNA, 19 nt, Artificial Sequence
  Description of Artificial Sequence:  synthetic
uguaaucuugaacauagac

SEQ ID NO: 1216 - RNA, 19 nt, Artificial Sequence
  Description of Artificial Sequence:  synthetic
aagcaauaaauggagaucu

SEQ ID NO: 1217 - RNA, 19 nt, Artificial Sequence
  Description of Artificial Sequence:  synthetic
cauguuggucacuaacaga

SEQ ID NO: 1218 - RNA, 19 nt, Artificial Sequence
  Description of Artificial Sequence:  synthetic
caguaauguacacgacucc

SEQ ID NO: 1219 - RNA, 19 nt, Artificial Sequence
  Description of Artificial Sequence:  synthetic
caguuuuguuuuuguucuc

SEQ ID NO: 1220 - RNA, 19 nt, Artificial Sequence
  Description of Artificial Sequence:  synthetic
cgagacauggaaucaccac

SEQ ID NO: 1221 - RNA, 19 nt, Artificial Sequence
  Description of Artificial Sequence:  synthetic
ugagauuugaaauggaccc

SEQ ID NO: 1222 - RNA, 19 nt, Artificial Sequence
  Description of Artificial Sequence:  synthetic
uugcacaaagugacacguu

SEQ ID NO: 1223 - RNA, 19 nt, Artificial Sequence
  Description of Artificial Sequence:  synthetic
aucucuuuucuggguaucu

SEQ ID NO: 1224 - RNA, 19 nt, Artificial Sequence
  Description of Artificial Sequence:  synthetic
uguuaccaucaggaacaaa

SEQ ID NO: 1225 - RNA, 19 nt, Artificial Sequence
  Description of Artificial Sequence:  synthetic
ugcugucccaggaaauucu

SEQ ID NO: 1226 - RNA, 19 nt, Artificial Sequence
  Description of Artificial Sequence:  synthetic
gaauaguaaagcccuucuu

SEQ ID NO: 1227 - RNA, 19 nt, Artificial Sequence
  Description of Artificial Sequence:  synthetic
agcugaucauguagcuggg

SEQ ID NO: 1228 - RNA, 19 nt, Artificial Sequence
  Description of Artificial Sequence:  synthetic
agaagaccaugccagcaua

SEQ ID NO: 1229 - RNA, 19 nt, Artificial Sequence
  Description of Artificial Sequence:  synthetic
cauuaauuuuugcuucaca

SEQ ID NO: 1230 - RNA, 19 nt, Artificial Sequence
  Description of Artificial Sequence:  synthetic
uagacugguaacuuucauc

SEQ ID NO: 1231 - RNA, 19 nt, Artificial Sequence
  Description of Artificial Sequence:  synthetic
cgacaacuauguacauaau

SEQ ID NO: 1232 - RNA, 19 nt, Artificial Sequence
  Description of Artificial Sequence:  synthetic
aaauccuauacccuacaac

SEQ ID NO: 1233 - RNA, 19 nt, Artificial Sequence
  Description of Artificial Sequence:  synthetic
gacucagaaccacaucaua

SEQ ID NO: 1234 - RNA, 19 nt, Artificial Sequence
  Description of Artificial Sequence:  synthetic
guucaauuccaugagacgg

SEQ ID NO: 1235 - RNA, 19 nt, Artificial Sequence
  Description of Artificial Sequence:  synthetic
gcuuuucuccaacagauag

SEQ ID NO: 1236 - RNA, 19 nt, Artificial Sequence
  Description of Artificial Sequence:  synthetic
cuguacaauuuaagacaag

SEQ ID NO: 1237 - RNA, 19 nt, Artificial Sequence
  Description of Artificial Sequence:  synthetic
cauuuaguucaguucuugc

SEQ ID NO: 1238 - RNA, 19 nt, Artificial Sequence
  Description of Artificial Sequence:  synthetic
aguugaagucaauccccac

SEQ ID NO: 1239 - RNA, 19 nt, Artificial Sequence
  Description of Artificial Sequence:  synthetic
ucgaagaaggguauuccca

SEQ ID NO: 1240 - RNA, 19 nt, Artificial Sequence
  Description of Artificial Sequence:  synthetic
guuucuuaugcugaugcuu

SEQ ID NO: 1241 - RNA, 19 nt, Artificial Sequence
  Description of Artificial Sequence:  synthetic
uuaggucucgguuuacaag

SEQ ID NO: 1242 - RNA, 19 nt, Artificial Sequence
  Description of Artificial Sequence:  synthetic
cacucccagacuggguuuu

SEQ ID NO: 1243 - RNA, 19 nt, Artificial Sequence
  Description of Artificial Sequence:  synthetic
ucaaaaauuucuucaucuc

SEQ ID NO: 1244 - RNA, 19 nt, Artificial Sequence
  Description of Artificial Sequence:  synthetic
caucuauaguuaaggugcu

SEQ ID NO: 1245 - RNA, 19 nt, Artificial Sequence
  Description of Artificial Sequence:  synthetic
ggucacuccggguuacacc

SEQ ID NO: 1246 - RNA, 19 nt, Artificial Sequence
  Description of Artificial Sequence:  synthetic
cacagguguacaauccuug

SEQ ID NO: 1247 - RNA, 19 nt, Artificial Sequence
  Description of Artificial Sequence:  synthetic
ucagcccacuggaugcugc

SEQ ID NO: 1248 - RNA, 19 nt, Artificial Sequence
  Description of Artificial Sequence:  synthetic
ugcuguucuucuuggucau

SEQ ID NO: 1249 - RNA, 19 nt, Artificial Sequence
  Description of Artificial Sequence:  synthetic
cauggacccugacaaaugu

SEQ ID NO: 1250 - RNA, 19 nt, Artificial Sequence
  Description of Artificial Sequence:  synthetic
aagcaacaaaagguuuuuc

SEQ ID NO: 1251 - RNA, 19 nt, Artificial Sequence
  Description of Artificial Sequence:  synthetic
auuccaugccacuuccaaa

SEQ ID NO: 1252 - RNA, 19 nt, Artificial Sequence
  Description of Artificial Sequence:  synthetic
ccguggcuuccaccagaga

SEQ ID NO: 1253 - RNA, 19 nt, Artificial Sequence
  Description of Artificial Sequence:  synthetic
uucugacacgcucccccac

SEQ ID NO: 1254 - RNA, 19 nt, Artificial Sequence
  Description of Artificial Sequence:  synthetic
caagguacuucgcagggau

SEQ ID NO: 1255 - RNA, 19 nt, Artificial Sequence
  Description of Artificial Sequence:  synthetic
uuucuggggguggguaacc

SEQ ID NO: 1256 - RNA, 19 nt, Artificial Sequence
  Description of Artificial Sequence:  synthetic
cauuuuuauaccauuuuau

SEQ ID NO: 1257 - RNA, 19 nt, Artificial Sequence
  Description of Artificial Sequence:  synthetic
uggacucaagggguauucc

SEQ ID NO: 1258 - RNA, 19 nt, Artificial Sequence
  Description of Artificial Sequence:  synthetic
ccgcuuuaauugugugauu

SEQ ID NO: 1259 - RNA, 19 nt, Artificial Sequence
  Description of Artificial Sequence:  synthetic
uaaucgucaguacaugccc

SEQ ID NO: 1260 - RNA, 19 nt, Artificial Sequence
  Description of Artificial Sequence:  synthetic
cucuuucacucacuuccau

SEQ ID NO: 1261 - RNA, 19 nt, Artificial Sequence
  Description of Artificial Sequence:  synthetic
caguguaauuuccuguguc

SEQ ID NO: 1262 - RNA, 19 nt, Artificial Sequence
  Description of Artificial Sequence:  synthetic
ugggauugguaaggaugac

SEQ ID NO: 1263 - RNA, 19 nt, Artificial Sequence
  Description of Artificial Sequence:  synthetic
ucugcuucuccuuugaaau

SEQ ID NO: 1264 - RNA, 19 nt, Artificial Sequence
  Description of Artificial Sequence:  synthetic
ccagagagaccacauggcu

SEQ ID NO: 1265 - RNA, 19 nt, Artificial Sequence
  Description of Artificial Sequence:  synthetic
ggggugggacauacacaac

SEQ ID NO: 1266 - RNA, 19 nt, Artificial Sequence
  Description of Artificial Sequence:  synthetic
gagauuucucaccaaucug

SEQ ID NO: 1267 - RNA, 19 nt, Artificial Sequence
  Description of Artificial Sequence:  synthetic
aauccacaggagagauuag

SEQ ID NO: 1268 - RNA, 19 nt, Artificial Sequence
  Description of Artificial Sequence:  synthetic
uggugccguacugguagga

SEQ ID NO: 1269 - RNA, 19 nt, Artificial Sequence
  Description of Artificial Sequence:  synthetic
uacaugucagcguuugagu

SEQ ID NO: 1270 - RNA, 19 nt, Artificial Sequence
  Description of Artificial Sequence:  synthetic
gaggaauggcauagaccgu

SEQ ID NO: 1271 - RNA, 19 nt, Artificial Sequence
  Description of Artificial Sequence:  synthetic
aguggaugugaugcggggg

SEQ ID NO: 1272 - RNA, 19 nt, Artificial Sequence
  Description of Artificial Sequence:  synthetic
ccuccaacugccaauacca

SEQ ID NO: 1273 - RNA, 19 nt, Artificial Sequence
  Description of Artificial Sequence:  synthetic
gcucguuggcgcacucuuc

SEQ ID NO: 1274 - RNA, 19 nt, Artificial Sequence
  Description of Artificial Sequence:  synthetic
cugagacagcuuggcuggg

SEQ ID NO: 1275 - RNA, 19 nt, Artificial Sequence
  Description of Artificial Sequence:  synthetic
aaggguauggguuugucac

SEQ ID NO: 1276 - RNA, 19 nt, Artificial Sequence
  Description of Artificial Sequence:  synthetic
cacuucuccauucuucaca

SEQ ID NO: 1277 - RNA, 19 nt, Artificial Sequence
  Description of Artificial Sequence:  synthetic
cucccuggaaguccuccac

SEQ ID NO: 1278 - RNA, 19 nt, Artificial Sequence
  Description of Artificial Sequence:  synthetic
uaacuucaauuuuauuucc

SEQ ID NO: 1279 - RNA, 19 nt, Artificial Sequence
  Description of Artificial Sequence:  synthetic
gagcaaauugauuuuuauu

SEQ ID NO: 1280 - RNA, 19 nt, Artificial Sequence
  Description of Artificial Sequence:  synthetic
uguuuuuuccuucaauuag

SEQ ID NO: 1281 - RNA, 19 nt, Artificial Sequence
  Description of Artificial Sequence:  synthetic
caaggguacuuacaguuuu

SEQ ID NO: 1282 - RNA, 19 nt, Artificial Sequence
  Description of Artificial Sequence:  synthetic
cauuugccgcuuggauaac

SEQ ID NO: 1283 - RNA, 19 nt, Artificial Sequence
  Description of Artificial Sequence:  synthetic
auuuguacaaagcugacac

SEQ ID NO: 1284 - RNA, 19 nt, Artificial Sequence
  Description of Artificial Sequence:  synthetic
cuuuguugaccgcuucaca

SEQ ID NO: 1285 - RNA, 19 nt, Artificial Sequence
  Description of Artificial Sequence:  synthetic
cccucucuccucucccgac

SEQ ID NO: 1286 - RNA, 19 nt, Artificial Sequence
  Description of Artificial Sequence:  synthetic
ucacguggaaggagaucac

SEQ ID NO: 1287 - RNA, 19 nt, Artificial Sequence
  Description of Artificial Sequence:  synthetic
uaauuucaggaccccuggu

SEQ ID NO: 1288 - RNA, 19 nt, Artificial Sequence
  Description of Artificial Sequence:  synthetic
gcaugucagguugcaaagu

SEQ ID NO: 1289 - RNA, 19 nt, Artificial Sequence
  Description of Artificial Sequence:  synthetic
ucuccugcucagugggcug

SEQ ID NO: 1290 - RNA, 19 nt, Artificial Sequence
  Description of Artificial Sequence:  synthetic
ugcaccacaaagacacgcu

SEQ ID NO: 1291 - RNA, 19 nt, Artificial Sequence
  Description of Artificial Sequence:  synthetic
acguagaucugucugcagu

SEQ ID NO: 1292 - RNA, 19 nt, Artificial Sequence
  Description of Artificial Sequence:  synthetic
accaugugagguucucaaa

SEQ ID NO: 1293 - RNA, 19 nt, Artificial Sequence
  Description of Artificial Sequence:  synthetic
gcugugggccaagcuugua

SEQ ID NO: 1294 - RNA, 19 nt, Artificial Sequence
  Description of Artificial Sequence:  synthetic
ccacauggauuggcagagg

SEQ ID NO: 1295 - RNA, 19 nt, Artificial Sequence
  Description of Artificial Sequence:  synthetic
caggugugggcaacucucc

SEQ ID NO: 1296 - RNA, 19 nt, Artificial Sequence
  Description of Artificial Sequence:  synthetic
uauccaaguucuugcaaac

SEQ ID NO: 1297 - RNA, 19 nt, Artificial Sequence
  Description of Artificial Sequence:  synthetic
cauucaauuuccaaagagu

SEQ ID NO: 1298 - RNA, 19 nt, Artificial Sequence
  Description of Artificial Sequence:  synthetic
uauuagagaacaugguggc

SEQ ID NO: 1299 - RNA, 19 nt, Artificial Sequence
  Description of Artificial Sequence:  synthetic
ucaaaaugucauuugugcu

SEQ ID NO: 1300 - RNA, 19 nt, Artificial Sequence
  Description of Artificial Sequence:  synthetic
cauucuuaagcuccaugau

SEQ ID NO: 1301 - RNA, 19 nt, Artificial Sequence
  Description of Artificial Sequence:  synthetic
cuugguccugcaaggaugc

SEQ ID NO: 1302 - RNA, 19 nt, Artificial Sequence
  Description of Artificial Sequence:  synthetic
caaggcagacauagucucc

SEQ ID NO: 1303 - RNA, 19 nt, Artificial Sequence
  Description of Artificial Sequence:  synthetic
uggucuuccugucuugagc

SEQ ID NO: 1304 - RNA, 19 nt, Artificial Sequence
  Description of Artificial Sequence:  synthetic
ccacgcaaugucuuuucuu

SEQ ID NO: 1305 - RNA, 19 nt, Artificial Sequence
  Description of Artificial Sequence:  synthetic
ggacugugagcugccugac

SEQ ID NO: 1306 - RNA, 19 nt, Artificial Sequence
  Description of Artificial Sequence:  synthetic
ugggugccacacgcucuag

SEQ ID NO: 1307 - RNA, 19 nt, Artificial Sequence
  Description of Artificial Sequence:  synthetic
ccagguuuccugugaucgu

SEQ ID NO: 1308 - RNA, 19 nt, Artificial Sequence
  Description of Artificial Sequence:  synthetic
uacuugucgucugauucuc

SEQ ID NO: 1309 - RNA, 19 nt, Artificial Sequence
  Description of Artificial Sequence:  synthetic
cuucgaugcuuuccccaau

SEQ ID NO: 1310 - RNA, 19 nt, Artificial Sequence
  Description of Artificial Sequence:  synthetic
cagaugccgugcaugagac

SEQ ID NO: 1311 - RNA, 19 nt, Artificial Sequence
  Description of Artificial Sequence:  synthetic
ucuguggagggggauuccc

SEQ ID NO: 1312 - RNA, 19 nt, Artificial Sequence
  Description of Artificial Sequence:  synthetic
uaucuuuaaaccacaugau

SEQ ID NO: 1313 - RNA, 19 nt, Artificial Sequence
  Description of Artificial Sequence:  synthetic
cuucuacaagggucucauu

SEQ ID NO: 1314 - RNA, 19 nt, Artificial Sequence
  Description of Artificial Sequence:  synthetic
ucaauacaaugccugaguc

SEQ ID NO: 1315 - RNA, 19 nt, Artificial Sequence
  Description of Artificial Sequence:  synthetic
gguuccgguucccauccuu

SEQ ID NO: 1316 - RNA, 19 nt, Artificial Sequence
  Description of Artificial Sequence:  synthetic
ucacucugcggauagugag

SEQ ID NO: 1317 - RNA, 19 nt, Artificial Sequence
  Description of Artificial Sequence:  synthetic
ggccuucguccuccuuccu

SEQ ID NO: 1318 - RNA, 19 nt, Artificial Sequence
  Description of Artificial Sequence:  synthetic
augccuggcagguguagag

SEQ ID NO: 1319 - RNA, 19 nt, Artificial Sequence
  Description of Artificial Sequence:  synthetic
cacagccaagaacacugca

SEQ ID NO: 1320 - RNA, 19 nt, Artificial Sequence
  Description of Artificial Sequence:  synthetic
aaaaugccuccacuuuugc

SEQ ID NO: 1321 - RNA, 19 nt, Artificial Sequence
  Description of Artificial Sequence:  synthetic
gggcaccuucuauuaugaa

SEQ ID NO: 1322 - RNA, 19 nt, Artificial Sequence
  Description of Artificial Sequence:  synthetic
ccaaguucgucuuuuccug

SEQ ID NO: 1323 - RNA, 19 nt, Artificial Sequence
  Description of Artificial Sequence:  synthetic
cuacuagaauaaugauuuc

SEQ ID NO: 1324 - RNA, 19 nt, Artificial Sequence
  Description of Artificial Sequence:  synthetic
uggcaaucaccgccgugcc

SEQ ID NO: 1325 - RNA, 19 nt, Artificial Sequence
  Description of Artificial Sequence:  synthetic
gaaguagccagaagaacau

SEQ ID NO: 1326 - RNA, 19 nt, Artificial Sequence
  Description of Artificial Sequence:  synthetic
uccguaggaugaugacaag

SEQ ID NO: 1327 - RNA, 19 nt, Artificial Sequence
  Description of Artificial Sequence:  synthetic
cauuggcccgcuuaacggu

SEQ ID NO: 1328 - RNA, 19 nt, Artificial Sequence
  Description of Artificial Sequence:  synthetic
cugucuucaguuccccucc

SEQ ID NO: 1329 - RNA, 19 nt, Artificial Sequence
  Description of Artificial Sequence:  synthetic
ugacgauggacaaguagcc

SEQ ID NO: 1330 - RNA, 19 nt, Artificial Sequence
  Description of Artificial Sequence:  synthetic
ggaguucaucuggauccau

SEQ ID NO: 1331 - RNA, 19 nt, Artificial Sequence
  Description of Artificial Sequence:  synthetic
cacaauguucauccaaugg

SEQ ID NO: 1332 - RNA, 19 nt, Artificial Sequence
  Description of Artificial Sequence:  synthetic
caucauaaggcagucguuc

SEQ ID NO: 1333 - RNA, 19 nt, Artificial Sequence
  Description of Artificial Sequence:  synthetic
ggaauucccauuugcuggc

SEQ ID NO: 1334 - RNA, 19 nt, Artificial Sequence
  Description of Artificial Sequence:  synthetic
gcuucagccggucucuggg

SEQ ID NO: 1335 - RNA, 19 nt, Artificial Sequence
  Description of Artificial Sequence:  synthetic
ggccaagaggcuuaccuag

SEQ ID NO: 1336 - RNA, 19 nt, Artificial Sequence
  Description of Artificial Sequence:  synthetic
cuuggccaaaggcaccacg

SEQ ID NO: 1337 - RNA, 19 nt, Artificial Sequence
  Description of Artificial Sequence:  synthetic
aggcaucugcuucaaucac

SEQ ID NO: 1338 - RNA, 19 nt, Artificial Sequence
  Description of Artificial Sequence:  synthetic
cugucuugucaauuccaaa

SEQ ID NO: 1339 - RNA, 19 nt, Artificial Sequence
  Description of Artificial Sequence:  synthetic
cuacuguccugcaaguugc

SEQ ID NO: 1340 - RNA, 19 nt, Artificial Sequence
  Description of Artificial Sequence:  synthetic
cuuucaacauuuugacugc

SEQ ID NO: 1341 - RNA, 19 nt, Artificial Sequence
  Description of Artificial Sequence:  synthetic
cacuguguguugcuccuuc

SEQ ID NO: 1342 - RNA, 19 nt, Artificial Sequence
  Description of Artificial Sequence:  synthetic
acaugagagcucgaugcuc

SEQ ID NO: 1343 - RNA, 19 nt, Artificial Sequence
  Description of Artificial Sequence:  synthetic
ugaggaucuugaguucaga

SEQ ID NO: 1344 - RNA, 19 nt, Artificial Sequence
  Description of Artificial Sequence:  synthetic
gauggugaccaauaugaau

SEQ ID NO: 1345 - RNA, 19 nt, Artificial Sequence
  Description of Artificial Sequence:  synthetic
gaagguugaccacauugag

SEQ ID NO: 1346 - RNA, 19 nt, Artificial Sequence
  Description of Artificial Sequence:  synthetic
gcuugguacaggcaccuag

SEQ ID NO: 1347 - RNA, 19 nt, Artificial Sequence
  Description of Artificial Sequence:  synthetic
ccaugaguggcccuccugg

SEQ ID NO: 1348 - RNA, 19 nt, Artificial Sequence
  Description of Artificial Sequence:  synthetic
ugcagaauuccacaaucac

SEQ ID NO: 1349 - RNA, 19 nt, Artificial Sequence
  Description of Artificial Sequence:  synthetic
uggacagguuuccaaauuu

SEQ ID NO: 1350 - RNA, 19 nt, Artificial Sequence
  Description of Artificial Sequence:  synthetic
ucuugcuccucagguaagu

SEQ ID NO: 1351 - RNA, 19 nt, Artificial Sequence
  Description of Artificial Sequence:  synthetic
aggggacaaauucauuucu

SEQ ID NO: 1352 - RNA, 19 nt, Artificial Sequence
  Description of Artificial Sequence:  synthetic
gugccccuuuggucuugua

SEQ ID NO: 1353 - RNA, 19 nt, Artificial Sequence
  Description of Artificial Sequence:  synthetic
cuuucccuugacggaaucg

SEQ ID NO: 1354 - RNA, 19 nt, Artificial Sequence
  Description of Artificial Sequence:  synthetic
ggauugcuccaacguaguc

SEQ ID NO: 1355 - RNA, 19 nt, Artificial Sequence
  Description of Artificial Sequence:  synthetic
gccguuucagauccacagg

SEQ ID NO: 1356 - RNA, 19 nt, Artificial Sequence
  Description of Artificial Sequence:  synthetic
uggugaugcuguccaagcg

SEQ ID NO: 1357 - RNA, 19 nt, Artificial Sequence
  Description of Artificial Sequence:  synthetic
uggcugagcucuggcuacu

SEQ ID NO: 1358 - RNA, 19 nt, Artificial Sequence
  Description of Artificial Sequence:  synthetic
ccuccacaaauccagagcu

SEQ ID NO: 1359 - RNA, 19 nt, Artificial Sequence
  Description of Artificial Sequence:  synthetic
caucacugagggacuucuc

SEQ ID NO: 1360 - RNA, 19 nt, Artificial Sequence
  Description of Artificial Sequence:  synthetic
gagcuuccucuucuucuac

SEQ ID NO: 1361 - RNA, 19 nt, Artificial Sequence
  Description of Artificial Sequence:  synthetic
ccuuauacagaucuucagg

SEQ ID NO: 1362 - RNA, 19 nt, Artificial Sequence
  Description of Artificial Sequence:  synthetic
gcuccaaggucaggaaguc

SEQ ID NO: 1363 - RNA, 19 nt, Artificial Sequence
  Description of Artificial Sequence:  synthetic
agcuguaacagaugagaug

SEQ ID NO: 1364 - RNA, 19 nt, Artificial Sequence
  Description of Artificial Sequence:  synthetic
ugcccuuagccacuuggaa

SEQ ID NO: 1365 - RNA, 19 nt, Artificial Sequence
  Description of Artificial Sequence:  synthetic
gcgaugccaagaacuccau

SEQ ID NO: 1366 - RNA, 19 nt, Artificial Sequence
  Description of Artificial Sequence:  synthetic
cccuguggauacacuuucg

SEQ ID NO: 1367 - RNA, 19 nt, Artificial Sequence
  Description of Artificial Sequence:  synthetic
uauuucgugccgccagguc

SEQ ID NO: 1368 - RNA, 19 nt, Artificial Sequence
  Description of Artificial Sequence:  synthetic
ucuucuccgauaagaggau

SEQ ID NO: 1369 - RNA, 19 nt, Artificial Sequence
  Description of Artificial Sequence:  synthetic
cacagauuuuaaccacguu

SEQ ID NO: 1370 - RNA, 19 nt, Artificial Sequence
  Description of Artificial Sequence:  synthetic
cccgggccaagccaaaguc

SEQ ID NO: 1371 - RNA, 19 nt, Artificial Sequence
  Description of Artificial Sequence:  synthetic
cuggaucuuuauaaauauc

SEQ ID NO: 1372 - RNA, 19 nt, Artificial Sequence
  Description of Artificial Sequence:  synthetic
cuccuuuucugacauaauc

SEQ ID NO: 1373 - RNA, 19 nt, Artificial Sequence
  Description of Artificial Sequence:  synthetic
ucaaagggaggcgagcauc

SEQ ID NO: 1374 - RNA, 19 nt, Artificial Sequence
  Description of Artificial Sequence:  synthetic
uuucuggggccauccauuu

SEQ ID NO: 1375 - RNA, 19 nt, Artificial Sequence
  Description of Artificial Sequence:  synthetic
acacucugucaaaaauugu

SEQ ID NO: 1376 - RNA, 19 nt, Artificial Sequence
  Description of Artificial Sequence:  synthetic
cgucacucuggauugugua

SEQ ID NO: 1377 - RNA, 19 nt, Artificial Sequence
  Description of Artificial Sequence:  synthetic
aaacaccaaaagaccagac

SEQ ID NO: 1378 - RNA, 19 nt, Artificial Sequence
  Description of Artificial Sequence:  synthetic
aaaauauuucccacagcaa

SEQ ID NO: 1379 - RNA, 19 nt, Artificial Sequence
  Description of Artificial Sequence:  synthetic
auggagaagcaccuaagga

SEQ ID NO: 1380 - RNA, 19 nt, Artificial Sequence
  Description of Artificial Sequence:  synthetic
caaucuuuaccccaggaua

SEQ ID NO: 1381 - RNA, 19 nt, Artificial Sequence
  Description of Artificial Sequence:  synthetic
gccuacaaaauucuucauc

SEQ ID NO: 1382 - RNA, 19 nt, Artificial Sequence
  Description of Artificial Sequence:  synthetic
uaguuccuucuuucaaucg

SEQ ID NO: 1383 - RNA, 19 nt, Artificial Sequence
  Description of Artificial Sequence:  synthetic
aaucaggggcccucauucu

SEQ ID NO: 1384 - RNA, 19 nt, Artificial Sequence
  Description of Artificial Sequence:  synthetic
acauuucugguguaguaua

SEQ ID NO: 1385 - RNA, 19 nt, Artificial Sequence
  Description of Artificial Sequence:  synthetic
aguccagcauggucuggua

SEQ ID NO: 1386 - RNA, 19 nt, Artificial Sequence
  Description of Artificial Sequence:  synthetic
ugggcuccccgugccagca

SEQ ID NO: 1387 - RNA, 19 nt, Artificial Sequence
  Description of Artificial Sequence:  synthetic
aaaacgugggucucugacu

SEQ ID NO: 1388 - RNA, 19 nt, Artificial Sequence
  Description of Artificial Sequence:  synthetic
aauguuccaccaacucuga

SEQ ID NO: 1389 - RNA, 19 nt, Artificial Sequence
  Description of Artificial Sequence:  synthetic
cuugcaagagauuucccaa

SEQ ID NO: 1390 - RNA, 19 nt, Artificial Sequence
  Description of Artificial Sequence:  synthetic
cauccugcugagcauuagc

SEQ ID NO: 1391 - RNA, 19 nt, Artificial Sequence
  Description of Artificial Sequence:  synthetic
gaacaauguagucuuugcc

SEQ ID NO: 1392 - RNA, 19 nt, Artificial Sequence
  Description of Artificial Sequence:  synthetic
aagucucugauaucggaag

SEQ ID NO: 1393 - RNA, 19 nt, Artificial Sequence
  Description of Artificial Sequence:  synthetic
aauccucuuccaugcucaa

SEQ ID NO: 1394 - RNA, 19 nt, Artificial Sequence
  Description of Artificial Sequence:  synthetic
uaggcagagagaguccaga

SEQ ID NO: 1395 - RNA, 19 nt, Artificial Sequence
  Description of Artificial Sequence:  synthetic
uacaggaaacaggugaggu

SEQ ID NO: 1396 - RNA, 19 nt, Artificial Sequence
  Description of Artificial Sequence:  synthetic
auacuuccuccuccuccau

SEQ ID NO: 1397 - RNA, 19 nt, Artificial Sequence
  Description of Artificial Sequence:  synthetic
aauggaauuuggggucaca

SEQ ID NO: 1398 - RNA, 19 nt, Artificial Sequence
  Description of Artificial Sequence:  synthetic
uuccugcuguguugucaua

SEQ ID NO: 1399 - RNA, 19 nt, Artificial Sequence
  Description of Artificial Sequence:  synthetic
ucugcagauacugacugau

SEQ ID NO: 1400 - RNA, 19 nt, Artificial Sequence
  Description of Artificial Sequence:  synthetic
ggcucuuucgcuuacuguu

SEQ ID NO: 1401 - RNA, 19 nt, Artificial Sequence
  Description of Artificial Sequence:  synthetic
uuuuuacacucacaggccg

SEQ ID NO: 1402 - RNA, 19 nt, Artificial Sequence
  Description of Artificial Sequence:  synthetic
acgggauaucuucaaaugu

SEQ ID NO: 1403 - RNA, 19 nt, Artificial Sequence
  Description of Artificial Sequence:  synthetic
uuacuucugguucuucuaa

SEQ ID NO: 1404 - RNA, 19 nt, Artificial Sequence
  Description of Artificial Sequence:  synthetic
ugucaucugggauuacuuu

SEQ ID NO: 1405 - RNA, 19 nt, Artificial Sequence
  Description of Artificial Sequence:  synthetic
uaccacuguccgucugguu

SEQ ID NO: 1406 - RNA, 19 nt, Artificial Sequence
  Description of Artificial Sequence:  synthetic
cuucugaggcaagaaccau

SEQ ID NO: 1407 - RNA, 19 nt, Artificial Sequence
  Description of Artificial Sequence:  synthetic
cuuccaaaguuuucagcuc

SEQ ID NO: 1408 - RNA, 19 nt, Artificial Sequence
  Description of Artificial Sequence:  synthetic
gagauaauuugguucuguc

SEQ ID NO: 1409 - RNA, 19 nt, Artificial Sequence
  Description of Artificial Sequence:  synthetic
ccauuccaccaaaagaugg

SEQ ID NO: 1410 - RNA, 19 nt, Artificial Sequence
  Description of Artificial Sequence:  synthetic
cccugcuuuugcugggcac

SEQ ID NO: 1411 - RNA, 19 nt, Artificial Sequence
  Description of Artificial Sequence:  synthetic
cuucagaugccacagacuc

SEQ ID NO: 1412 - RNA, 19 nt, Artificial Sequence
  Description of Artificial Sequence:  synthetic
cgcuugucugguuugagcc

SEQ ID NO: 1413 - RNA, 19 nt, Artificial Sequence
  Description of Artificial Sequence:  synthetic
gauauccggacugguagcc

SEQ ID NO: 1414 - RNA, 19 nt, Artificial Sequence
  Description of Artificial Sequence:  synthetic
ugucugugucaucggagug

SEQ ID NO: 1415 - RNA, 19 nt, Artificial Sequence
  Description of Artificial Sequence:  synthetic
cacuggaguacacgguggu

SEQ ID NO: 1416 - RNA, 19 nt, Artificial Sequence
  Description of Artificial Sequence:  synthetic
uuaaaaguucugcuuccuc

SEQ ID NO: 1417 - RNA, 19 nt, Artificial Sequence
  Description of Artificial Sequence:  synthetic
cuccaaucucuaucagcuu

SEQ ID NO: 1418 - RNA, 19 nt, Artificial Sequence
  Description of Artificial Sequence:  synthetic
cugugcuaccgguuugcac

SEQ ID NO: 1419 - RNA, 19 nt, Artificial Sequence
  Description of Artificial Sequence:  synthetic
caggcuggagaaucugggc

SEQ ID NO: 1420 - RNA, 19 nt, Artificial Sequence
  Description of Artificial Sequence:  synthetic
ucagugugguccccgaguc

SEQ ID NO: 1421 - RNA, 19 nt, Artificial Sequence
  Description of Artificial Sequence:  synthetic
uuuaaacaggaggagagcu

SEQ ID NO: 1422 - RNA, 19 nt, Artificial Sequence
  Description of Artificial Sequence:  synthetic
gggguguggaugcuuccuu

SEQ ID NO: 1423 - RNA, 19 nt, Artificial Sequence
  Description of Artificial Sequence:  synthetic
augugauguccgggaguug

SEQ ID NO: 1424 - RNA, 19 nt, Artificial Sequence
  Description of Artificial Sequence:  synthetic
aaucugagcagaccucuca

SEQ ID NO: 1425 - RNA, 19 nt, Artificial Sequence
  Description of Artificial Sequence:  synthetic
gaaagaacaacacuucaaa

SEQ ID NO: 1426 - RNA, 19 nt, Artificial Sequence
  Description of Artificial Sequence:  synthetic
ggcuacuuccugcuggugg

SEQ ID NO: 1427 - RNA, 19 nt, Artificial Sequence
  Description of Artificial Sequence:  synthetic
gaaaugaaaaucaaaugcg

SEQ ID NO: 1428 - RNA, 19 nt, Artificial Sequence
  Description of Artificial Sequence:  synthetic
gguccuuuuucuguugucg

SEQ ID NO: 1429 - RNA, 19 nt, Artificial Sequence
  Description of Artificial Sequence:  synthetic
uggcucccugcaguccgag

SEQ ID NO: 1430 - RNA, 19 nt, Artificial Sequence
  Description of Artificial Sequence:  synthetic
aggauaugccuagaagacu

SEQ ID NO: 1431 - RNA, 19 nt, Artificial Sequence
  Description of Artificial Sequence:  synthetic
gggucacaagccucuucca

SEQ ID NO: 1432 - RNA, 19 nt, Artificial Sequence
  Description of Artificial Sequence:  synthetic
agacacagacacauucuug

SEQ ID NO: 1433 - RNA, 19 nt, Artificial Sequence
  Description of Artificial Sequence:  synthetic
caggucaacacugggagaa

SEQ ID NO: 1434 - RNA, 19 nt, Artificial Sequence
  Description of Artificial Sequence:  synthetic
ugaaugaaaaaagaggauc

SEQ ID NO: 1435 - RNA, 19 nt, Artificial Sequence
  Description of Artificial Sequence:  synthetic
augauaaugcuuuuuaaau

SEQ ID NO: 1436 - RNA, 19 nt, Artificial Sequence
  Description of Artificial Sequence:  synthetic
gagacccgcagcaggggca

SEQ ID NO: 1437 - RNA, 19 nt, Artificial Sequence
  Description of Artificial Sequence:  synthetic
uuguucuaaacccauggug

SEQ ID NO: 1438 - RNA, 19 nt, Artificial Sequence
  Description of Artificial Sequence:  synthetic
gccauugcuugaagcucuu

SEQ ID NO: 1439 - RNA, 19 nt, Artificial Sequence
  Description of Artificial Sequence:  synthetic
uacuucuuugaggaugggg

SEQ ID NO: 1440 - RNA, 19 nt, Artificial Sequence
  Description of Artificial Sequence:  synthetic
cagcuccccagguacugcu

SEQ ID NO: 1441 - RNA, 19 nt, Artificial Sequence
  Description of Artificial Sequence:  synthetic
cuaguuuuacagaaguguc

SEQ ID NO: 1442 - RNA, 19 nt, Artificial Sequence
  Description of Artificial Sequence:  synthetic
cguugccugguuuaucuuc

SEQ ID NO: 1443 - RNA, 19 nt, Artificial Sequence
  Description of Artificial Sequence:  synthetic
caacaccucgaacacuuac

SEQ ID NO: 1444 - RNA, 19 nt, Artificial Sequence
  Description of Artificial Sequence:  synthetic
gcaaauccuucccaucuuc

SEQ ID NO: 1445 - RNA, 19 nt, Artificial Sequence
  Description of Artificial Sequence:  synthetic
uuggauagacucagcccug

SEQ ID NO: 1446 - RNA, 19 nt, Artificial Sequence
  Description of Artificial Sequence:  synthetic
cguccuaaacaaagccucu

SEQ ID NO: 1447 - RNA, 19 nt, Artificial Sequence
  Description of Artificial Sequence:  synthetic
ggcuuggcuugggacccac

SEQ ID NO: 1448 - RNA, 19 nt, Artificial Sequence
  Description of Artificial Sequence:  synthetic
uccgaauuccacacuuaag

SEQ ID NO: 1449 - RNA, 19 nt, Artificial Sequence
  Description of Artificial Sequence:  synthetic
agucuuccuuucuaucaau

SEQ ID NO: 1450 - RNA, 19 nt, Artificial Sequence
  Description of Artificial Sequence:  synthetic
ccaaagcaagguaacguua

SEQ ID NO: 1451 - RNA, 19 nt, Artificial Sequence
  Description of Artificial Sequence:  synthetic
ugcaggcuccaguacucuc

SEQ ID NO: 1452 - RNA, 19 nt, Artificial Sequence
  Description of Artificial Sequence:  synthetic
gagcaaacacaaugcauuu

SEQ ID NO: 1453 - RNA, 19 nt, Artificial Sequence
  Description of Artificial Sequence:  synthetic
ccaugcccaccuccaccag

SEQ ID NO: 1454 - RNA, 19 nt, Artificial Sequence
  Description of Artificial Sequence:  synthetic
uacauuucagaacagaccc

SEQ ID NO: 1455 - RNA, 19 nt, Artificial Sequence
  Description of Artificial Sequence:  synthetic
aaccccgucugaacccuuu

SEQ ID NO: 1456 - RNA, 19 nt, Artificial Sequence
  Description of Artificial Sequence:  synthetic
caaccuucuaaaaccagaa

SEQ ID NO: 1457 - RNA, 19 nt, Artificial Sequence
  Description of Artificial Sequence:  synthetic
cccaacucgaagaacacgc

SEQ ID NO: 1458 - RNA, 19 nt, Artificial Sequence
  Description of Artificial Sequence:  synthetic
caacgaacucuacuuuagc

SEQ ID NO: 1459 - RNA, 19 nt, Artificial Sequence
  Description of Artificial Sequence:  synthetic
uaggagucagaaacagcac

SEQ ID NO: 1460 - RNA, 19 nt, Artificial Sequence
  Description of Artificial Sequence:  synthetic
ucuggaaggaacucucauu

SEQ ID NO: 1461 - RNA, 19 nt, Artificial Sequence
  Description of Artificial Sequence:  synthetic
caaggagacagcuaacggu

SEQ ID NO: 1462 - RNA, 19 nt, Artificial Sequence
  Description of Artificial Sequence:  synthetic
uuucuuccuggggcuuggc

SEQ ID NO: 1463 - RNA, 19 nt, Artificial Sequence
  Description of Artificial Sequence:  synthetic
gagccagagcugcaucauu

SEQ ID NO: 1464 - RNA, 19 nt, Artificial Sequence
  Description of Artificial Sequence:  synthetic
aucagccugggagacaagg

SEQ ID NO: 1465 - RNA, 19 nt, Artificial Sequence
  Description of Artificial Sequence:  synthetic
ugguauucugaauaaagga

SEQ ID NO: 1466 - RNA, 19 nt, Artificial Sequence
  Description of Artificial Sequence:  synthetic
cugaauguccuuucuuugu

SEQ ID NO: 1467 - RNA, 19 nt, Artificial Sequence
  Description of Artificial Sequence:  synthetic
acggcagggagccuugagc

SEQ ID NO: 1468 - RNA, 19 nt, Artificial Sequence
  Description of Artificial Sequence:  synthetic
cagucagaacucuucaaca

SEQ ID NO: 1469 - RNA, 19 nt, Artificial Sequence
  Description of Artificial Sequence:  synthetic
accagaagcugguuugugc

SEQ ID NO: 1470 - RNA, 19 nt, Artificial Sequence
  Description of Artificial Sequence:  synthetic
guauucauuccagaagaaa

SEQ ID NO: 1471 - RNA, 19 nt, Artificial Sequence
  Description of Artificial Sequence:  synthetic
aucaggacagauaugaggg

SEQ ID NO: 1472 - RNA, 19 nt, Artificial Sequence
  Description of Artificial Sequence:  synthetic
cagucucagacauaucaca

SEQ ID NO: 1473 - RNA, 19 nt, Artificial Sequence
  Description of Artificial Sequence:  synthetic
cauugaaccucccgcauuc

SEQ ID NO: 1474 - RNA, 19 nt, Artificial Sequence
  Description of Artificial Sequence:  synthetic
acaccacacacagcuucac

SEQ ID NO: 1475 - RNA, 19 nt, Artificial Sequence
  Description of Artificial Sequence:  synthetic
auccuuccugaaacuuuga

SEQ ID NO: 1476 - RNA, 19 nt, Artificial Sequence
  Description of Artificial Sequence:  synthetic
gaagaacaaaaggguaaaa

SEQ ID NO: 1477 - RNA, 19 nt, Artificial Sequence
  Description of Artificial Sequence:  synthetic
guggguuggggacaggggg

SEQ ID NO: 1478 - RNA, 19 nt, Artificial Sequence
  Description of Artificial Sequence:  synthetic
auggguugcggggugagag

SEQ ID NO: 1479 - RNA, 19 nt, Artificial Sequence
  Description of Artificial Sequence:  synthetic
caaauaacuaaaauacuga

SEQ ID NO: 1480 - RNA, 19 nt, Artificial Sequence
  Description of Artificial Sequence:  synthetic
guuuacuggaguagaggcc

SEQ ID NO: 1481 - RNA, 19 nt, Artificial Sequence
  Description of Artificial Sequence:  synthetic
gugaacaaacccaaucagg

SEQ ID NO: 1482 - RNA, 19 nt, Artificial Sequence
  Description of Artificial Sequence:  synthetic
cuaauaaucauucagagag

SEQ ID NO: 1483 - RNA, 19 nt, Artificial Sequence
  Description of Artificial Sequence:  synthetic
aauaauuuugaagucuggc

SEQ ID NO: 1484 - RNA, 19 nt, Artificial Sequence
  Description of Artificial Sequence:  synthetic
uuauaauuugggcuauaaa

SEQ ID NO: 1485 - RNA, 19 nt, Artificial Sequence
  Description of Artificial Sequence:  synthetic
uaaauaauacaauagaugu

SEQ ID NO: 1486 - RNA, 19 nt, Artificial Sequence
  Description of Artificial Sequence:  synthetic
cucuauauguuaaaagucu

SEQ ID NO: 1487 - RNA, 19 nt, Artificial Sequence
  Description of Artificial Sequence:  synthetic
aaaaaucaguagaaauagc

SEQ ID NO: 1488 - RNA, 19 nt, Artificial Sequence
  Description of Artificial Sequence:  synthetic
aaaggacagaacaagggca

SEQ ID NO: 1489 - RNA, 19 nt, Artificial Sequence
  Description of Artificial Sequence:  synthetic
cauuuucuuuuuugaaaaa

SEQ ID NO: 1490 - RNA, 19 nt, Artificial Sequence
  Description of Artificial Sequence:  synthetic
gguaccaaacaaaaaacac

SEQ ID NO: 1491 - RNA, 19 nt, Artificial Sequence
  Description of Artificial Sequence:  synthetic
cccagcauuucacacuaug

SEQ ID NO: 1492 - RNA, 19 nt, Artificial Sequence
  Description of Artificial Sequence:  synthetic
ugucuuauagucauuguuc

SEQ ID NO: 1493 - RNA, 19 nt, Artificial Sequence
  Description of Artificial Sequence:  synthetic
aauauaugugccauagcau

SEQ ID NO: 1494 - RNA, 19 nt, Artificial Sequence
  Description of Artificial Sequence:  synthetic
cuacauaaacagacuauaa

SEQ ID NO: 1495 - RNA, 19 nt, Artificial Sequence
  Description of Artificial Sequence:  synthetic
aauauauuacauuuguuuc

SEQ ID NO: 1496 - RNA, 19 nt, Artificial Sequence
  Description of Artificial Sequence:  synthetic
cauuauauauaaggcuuua

SEQ ID NO: 1497 - RNA, 19 nt, Artificial Sequence
  Description of Artificial Sequence:  synthetic
ugugaauaguacaaaguuc

SEQ ID NO: 1498 - RNA, 19 nt, Artificial Sequence
  Description of Artificial Sequence:  synthetic
cauaauacugauacaaaau

SEQ ID NO: 1499 - RNA, 19 nt, Artificial Sequence
  Description of Artificial Sequence:  synthetic
augaccuuuguuaugcuac

SEQ ID NO: 1500 - RNA, 19 nt, Artificial Sequence
  Description of Artificial Sequence:  synthetic
ucaauugcugaaagcauua

SEQ ID NO: 1501 - RNA, 19 nt, Artificial Sequence
  Description of Artificial Sequence:  synthetic
uucuuuaauaaaaugacau

SEQ ID NO: 1502 - RNA, 19 nt, Artificial Sequence
  Description of Artificial Sequence:  synthetic
ucaaguuuuucaauguucu

SEQ ID NO: 1503 - RNA, 19 nt, Artificial Sequence
  Description of Artificial Sequence:  synthetic
acccacgcgcagcggccgg

SEQ ID NO: 1504 - RNA, 19 nt, Artificial Sequence
  Description of Artificial Sequence:  synthetic
gagaugcagcggggcgccg

SEQ ID NO: 1505 - RNA, 19 nt, Artificial Sequence
  Description of Artificial Sequence:  synthetic
gcgcugugccugcgacugu

SEQ ID NO: 1506 - RNA, 19 nt, Artificial Sequence
  Description of Artificial Sequence:  synthetic
uggcucugccugggacucc

SEQ ID NO: 1507 - RNA, 19 nt, Artificial Sequence
  Description of Artificial Sequence:  synthetic
cuggacggccuggugagug

SEQ ID NO: 1508 - RNA, 19 nt, Artificial Sequence
  Description of Artificial Sequence:  synthetic
gacuacuccaugacccccc

SEQ ID NO: 1509 - RNA, 19 nt, Artificial Sequence
  Description of Artificial Sequence:  synthetic
ccgaccuugaacaucacgg

SEQ ID NO: 1510 - RNA, 19 nt, Artificial Sequence
  Description of Artificial Sequence:  synthetic
gaggagucacacgucaucg

SEQ ID NO: 1511 - RNA, 19 nt, Artificial Sequence
  Description of Artificial Sequence:  synthetic
gacaccggugacagccugu

SEQ ID NO: 1512 - RNA, 19 nt, Artificial Sequence
  Description of Artificial Sequence:  synthetic
uccaucuccugcaggggac

SEQ ID NO: 1513 - RNA, 19 nt, Artificial Sequence
  Description of Artificial Sequence:  synthetic
cagcacccccucgaguggg

SEQ ID NO: 1514 - RNA, 19 nt, Artificial Sequence
  Description of Artificial Sequence:  synthetic
gcuuggccaggagcucagg

SEQ ID NO: 1515 - RNA, 19 nt, Artificial Sequence
  Description of Artificial Sequence:  synthetic
gaggcgccagccaccggag

SEQ ID NO: 1516 - RNA, 19 nt, Artificial Sequence
  Description of Artificial Sequence:  synthetic
gacaaggacagcgaggaca

SEQ ID NO: 1517 - RNA, 19 nt, Artificial Sequence
  Description of Artificial Sequence:  synthetic
acggggguggugcgagacu

SEQ ID NO: 1518 - RNA, 19 nt, Artificial Sequence
  Description of Artificial Sequence:  synthetic
ugcgagggcacagacgcca

SEQ ID NO: 1519 - RNA, 19 nt, Artificial Sequence
  Description of Artificial Sequence:  synthetic
aggcccuacugcaaggugu

SEQ ID NO: 1520 - RNA, 19 nt, Artificial Sequence
  Description of Artificial Sequence:  synthetic
uugcugcugcacgagguac

SEQ ID NO: 1521 - RNA, 19 nt, Artificial Sequence
  Description of Artificial Sequence:  synthetic
caugccaacgacacaggca

SEQ ID NO: 1522 - RNA, 19 nt, Artificial Sequence
  Description of Artificial Sequence:  synthetic
agcuacgucugcuacuaca

SEQ ID NO: 1523 - RNA, 19 nt, Artificial Sequence
  Description of Artificial Sequence:  synthetic
aaguacaucaaggcacgca

SEQ ID NO: 1524 - RNA, 19 nt, Artificial Sequence
  Description of Artificial Sequence:  synthetic
aucgagggcaccacggccg

SEQ ID NO: 1525 - RNA, 19 nt, Artificial Sequence
  Description of Artificial Sequence:  synthetic
gccagcuccuacguguucg

SEQ ID NO: 1526 - RNA, 19 nt, Artificial Sequence
  Description of Artificial Sequence:  synthetic
gugagagacuuugagcagc

SEQ ID NO: 1527 - RNA, 19 nt, Artificial Sequence
  Description of Artificial Sequence:  synthetic
ccauucaucaacaagccug

SEQ ID NO: 1528 - RNA, 19 nt, Artificial Sequence
  Description of Artificial Sequence:  synthetic
gacacgcucuuggucaaca

SEQ ID NO: 1529 - RNA, 19 nt, Artificial Sequence
  Description of Artificial Sequence:  synthetic
aggaaggacgccauguggg

SEQ ID NO: 1530 - RNA, 19 nt, Artificial Sequence
  Description of Artificial Sequence:  synthetic
gugcccugucuggugucca

SEQ ID NO: 1531 - RNA, 19 nt, Artificial Sequence
  Description of Artificial Sequence:  synthetic
auccccggccucaauguca

SEQ ID NO: 1532 - RNA, 19 nt, Artificial Sequence
  Description of Artificial Sequence:  synthetic
acgcugcgcucgcaaagcu

SEQ ID NO: 1533 - RNA, 19 nt, Artificial Sequence
  Description of Artificial Sequence:  synthetic
ucggugcuguggccagacg

SEQ ID NO: 1534 - RNA, 19 nt, Artificial Sequence
  Description of Artificial Sequence:  synthetic
gggcaggaggugguguggg

SEQ ID NO: 1535 - RNA, 19 nt, Artificial Sequence
  Description of Artificial Sequence:  synthetic
gaugaccggcggggcaugc

SEQ ID NO: 1536 - RNA, 19 nt, Artificial Sequence
  Description of Artificial Sequence:  synthetic
cucguguccacgccacugc

SEQ ID NO: 1537 - RNA, 19 nt, Artificial Sequence
  Description of Artificial Sequence:  synthetic
cugcacgaugcccuguacc

SEQ ID NO: 1538 - RNA, 19 nt, Artificial Sequence
  Description of Artificial Sequence:  synthetic
cugcagugcgagaccaccu

SEQ ID NO: 1539 - RNA, 19 nt, Artificial Sequence
  Description of Artificial Sequence:  synthetic
uggggagaccaggacuucc

SEQ ID NO: 1540 - RNA, 19 nt, Artificial Sequence
  Description of Artificial Sequence:  synthetic
cuuuccaaccccuuccugg

SEQ ID NO: 1541 - RNA, 19 nt, Artificial Sequence
  Description of Artificial Sequence:  synthetic
gugcacaucacaggcaacg

SEQ ID NO: 1542 - RNA, 19 nt, Artificial Sequence
  Description of Artificial Sequence:  synthetic
gagcucuaugacauccagc

SEQ ID NO: 1543 - RNA, 19 nt, Artificial Sequence
  Description of Artificial Sequence:  synthetic
cuguugcccaggaagucgc

SEQ ID NO: 1544 - RNA, 19 nt, Artificial Sequence
  Description of Artificial Sequence:  synthetic
cuggagcugcugguagggg

SEQ ID NO: 1545 - RNA, 19 nt, Artificial Sequence
  Description of Artificial Sequence:  synthetic
gagaagcugguccucaacu

SEQ ID NO: 1546 - RNA, 19 nt, Artificial Sequence
  Description of Artificial Sequence:  synthetic
ugcaccgugugggcugagu

SEQ ID NO: 1547 - RNA, 19 nt, Artificial Sequence
  Description of Artificial Sequence:  synthetic
uuuaacucaggugucaccu

SEQ ID NO: 1548 - RNA, 19 nt, Artificial Sequence
  Description of Artificial Sequence:  synthetic
uuugacugggacuacccag

SEQ ID NO: 1549 - RNA, 19 nt, Artificial Sequence
  Description of Artificial Sequence:  synthetic
gggaagcaggcagagcggg

SEQ ID NO: 1550 - RNA, 19 nt, Artificial Sequence
  Description of Artificial Sequence:  synthetic
gguaagugggugcccgagc

SEQ ID NO: 1551 - RNA, 19 nt, Artificial Sequence
  Description of Artificial Sequence:  synthetic
cgacgcucccaacagaccc

SEQ ID NO: 1552 - RNA, 19 nt, Artificial Sequence
  Description of Artificial Sequence:  synthetic
cacacagaacucuccagca

SEQ ID NO: 1553 - RNA, 19 nt, Artificial Sequence
  Description of Artificial Sequence:  synthetic
auccugaccauccacaacg

SEQ ID NO: 1554 - RNA, 19 nt, Artificial Sequence
  Description of Artificial Sequence:  synthetic
gucagccagcacgaccugg

SEQ ID NO: 1555 - RNA, 19 nt, Artificial Sequence
  Description of Artificial Sequence:  synthetic
ggcucguaugugugcaagg

SEQ ID NO: 1556 - RNA, 19 nt, Artificial Sequence
  Description of Artificial Sequence:  synthetic
gccaacaacggcauccagc

SEQ ID NO: 1557 - RNA, 19 nt, Artificial Sequence
  Description of Artificial Sequence:  synthetic
cgauuucgggagagcaccg

SEQ ID NO: 1558 - RNA, 19 nt, Artificial Sequence
  Description of Artificial Sequence:  synthetic
gaggucauugugcaugaaa

SEQ ID NO: 1559 - RNA, 19 nt, Artificial Sequence
  Description of Artificial Sequence:  synthetic
aaucccuucaucagcgucg

SEQ ID NO: 1560 - RNA, 19 nt, Artificial Sequence
  Description of Artificial Sequence:  synthetic
gaguggcucaaaggaccca

SEQ ID NO: 1561 - RNA, 19 nt, Artificial Sequence
  Description of Artificial Sequence:  synthetic
auccuggaggccacggcag

SEQ ID NO: 1562 - RNA, 19 nt, Artificial Sequence
  Description of Artificial Sequence:  synthetic
ggagacgagcuggugaagc

SEQ ID NO: 1563 - RNA, 19 nt, Artificial Sequence
  Description of Artificial Sequence:  synthetic
cugcccgugaagcuggcag

SEQ ID NO: 1564 - RNA, 19 nt, Artificial Sequence
  Description of Artificial Sequence:  synthetic
gcguaccccccgcccgagu

SEQ ID NO: 1565 - RNA, 19 nt, Artificial Sequence
  Description of Artificial Sequence:  synthetic
uuccagugguacaaggaug

SEQ ID NO: 1566 - RNA, 19 nt, Artificial Sequence
  Description of Artificial Sequence:  synthetic
ggaaaggcacuguccgggc

SEQ ID NO: 1567 - RNA, 19 nt, Artificial Sequence
  Description of Artificial Sequence:  synthetic
cgccacaguccacaugccc

SEQ ID NO: 1568 - RNA, 19 nt, Artificial Sequence
  Description of Artificial Sequence:  synthetic
cuggugcucaaggagguga

SEQ ID NO: 1569 - RNA, 19 nt, Artificial Sequence
  Description of Artificial Sequence:  synthetic
acagaggccagcacaggca

SEQ ID NO: 1570 - RNA, 19 nt, Artificial Sequence
  Description of Artificial Sequence:  synthetic
accuacacccucgcccugu

SEQ ID NO: 1571 - RNA, 19 nt, Artificial Sequence
  Description of Artificial Sequence:  synthetic
uggaacuccgcugcuggcc

SEQ ID NO: 1572 - RNA, 19 nt, Artificial Sequence
  Description of Artificial Sequence:  synthetic
cugaggcgcaacaucagcc

SEQ ID NO: 1573 - RNA, 19 nt, Artificial Sequence
  Description of Artificial Sequence:  synthetic
cuggagcugguggugaaug

SEQ ID NO: 1574 - RNA, 19 nt, Artificial Sequence
  Description of Artificial Sequence:  synthetic
gugcccccccagauacaug

SEQ ID NO: 1575 - RNA, 19 nt, Artificial Sequence
  Description of Artificial Sequence:  synthetic
gagaaggaggccuccuccc

SEQ ID NO: 1576 - RNA, 19 nt, Artificial Sequence
  Description of Artificial Sequence:  synthetic
cccagcaucuacucgcguc

SEQ ID NO: 1577 - RNA, 19 nt, Artificial Sequence
  Description of Artificial Sequence:  synthetic
cacagccgccaggcccuca

SEQ ID NO: 1578 - RNA, 19 nt, Artificial Sequence
  Description of Artificial Sequence:  synthetic
accugcacggccuacgggg

SEQ ID NO: 1579 - RNA, 19 nt, Artificial Sequence
  Description of Artificial Sequence:  synthetic
gugccccugccucucagca

SEQ ID NO: 1580 - RNA, 19 nt, Artificial Sequence
  Description of Artificial Sequence:  synthetic
auccaguggcacuggcggc

SEQ ID NO: 1581 - RNA, 19 nt, Artificial Sequence
  Description of Artificial Sequence:  synthetic
cccuggacacccugcaaga

SEQ ID NO: 1582 - RNA, 19 nt, Artificial Sequence
  Description of Artificial Sequence:  synthetic
auguuugcccagcguaguc

SEQ ID NO: 1583 - RNA, 19 nt, Artificial Sequence
  Description of Artificial Sequence:  synthetic
cuccggcggcggcagcagc

SEQ ID NO: 1584 - RNA, 19 nt, Artificial Sequence
  Description of Artificial Sequence:  synthetic
caagaccucaugccacagu

SEQ ID NO: 1585 - RNA, 19 nt, Artificial Sequence
  Description of Artificial Sequence:  synthetic
ugccgugacuggagggcgg

SEQ ID NO: 1586 - RNA, 19 nt, Artificial Sequence
  Description of Artificial Sequence:  synthetic
gugaccacgcaggaugccg

SEQ ID NO: 1587 - RNA, 19 nt, Artificial Sequence
  Description of Artificial Sequence:  synthetic
gugaaccccaucgagagcc

SEQ ID NO: 1588 - RNA, 19 nt, Artificial Sequence
  Description of Artificial Sequence:  synthetic
cuggacaccuggaccgagu

SEQ ID NO: 1589 - RNA, 19 nt, Artificial Sequence
  Description of Artificial Sequence:  synthetic
uuuguggagggaaagaaua

SEQ ID NO: 1590 - RNA, 19 nt, Artificial Sequence
  Description of Artificial Sequence:  synthetic
aagacugugagcaagcugg

SEQ ID NO: 1591 - RNA, 19 nt, Artificial Sequence
  Description of Artificial Sequence:  synthetic
gugauccagaaugccaacg

SEQ ID NO: 1592 - RNA, 19 nt, Artificial Sequence
  Description of Artificial Sequence:  synthetic
gugucugccauguacaagu

SEQ ID NO: 1593 - RNA, 19 nt, Artificial Sequence
  Description of Artificial Sequence:  synthetic
uguguggucuccaacaagg

SEQ ID NO: 1594 - RNA, 19 nt, Artificial Sequence
  Description of Artificial Sequence:  synthetic
gugggccaggaugagcggc

SEQ ID NO: 1595 - RNA, 19 nt, Artificial Sequence
  Description of Artificial Sequence:  synthetic
cucaucuacuucuauguga

SEQ ID NO: 1596 - RNA, 19 nt, Artificial Sequence
  Description of Artificial Sequence:  synthetic
accaccauccccgacggcu

SEQ ID NO: 1597 - RNA, 19 nt, Artificial Sequence
  Description of Artificial Sequence:  synthetic
uucaccaucgaauccaagc

SEQ ID NO: 1598 - RNA, 19 nt, Artificial Sequence
  Description of Artificial Sequence:  synthetic
ccauccgaggagcuacuag

SEQ ID NO: 1599 - RNA, 19 nt, Artificial Sequence
  Description of Artificial Sequence:  synthetic
gagggccagccggugcucc

SEQ ID NO: 1600 - RNA, 19 nt, Artificial Sequence
  Description of Artificial Sequence:  synthetic
cugagcugccaagccgaca

SEQ ID NO: 1601 - RNA, 19 nt, Artificial Sequence
  Description of Artificial Sequence:  synthetic
agcuacaaguacgagcauc

SEQ ID NO: 1602 - RNA, 19 nt, Artificial Sequence
  Description of Artificial Sequence:  synthetic
cugcgcugguaccgccuca

SEQ ID NO: 1603 - RNA, 19 nt, Artificial Sequence
  Description of Artificial Sequence:  synthetic
aaccuguccacgcugcacg

SEQ ID NO: 1604 - RNA, 19 nt, Artificial Sequence
  Description of Artificial Sequence:  synthetic
gaugcgcacgggaacccgc

SEQ ID NO: 1605 - RNA, 19 nt, Artificial Sequence
  Description of Artificial Sequence:  synthetic
cuucugcucgacugcaaga

SEQ ID NO: 1606 - RNA, 19 nt, Artificial Sequence
  Description of Artificial Sequence:  synthetic
aacgugcaucuguucgcca

SEQ ID NO: 1607 - RNA, 19 nt, Artificial Sequence
  Description of Artificial Sequence:  synthetic
accccucuggccgccagcc

SEQ ID NO: 1608 - RNA, 19 nt, Artificial Sequence
  Description of Artificial Sequence:  synthetic
cuggaggagguggcaccug

SEQ ID NO: 1609 - RNA, 19 nt, Artificial Sequence
  Description of Artificial Sequence:  synthetic
ggggcgcgccacgccacgc

SEQ ID NO: 1610 - RNA, 19 nt, Artificial Sequence
  Description of Artificial Sequence:  synthetic
cucagccugaguauccccc

SEQ ID NO: 1611 - RNA, 19 nt, Artificial Sequence
  Description of Artificial Sequence:  synthetic
cgcgucgcgcccgagcacg

SEQ ID NO: 1612 - RNA, 19 nt, Artificial Sequence
  Description of Artificial Sequence:  synthetic
gagggccacuaugugugcg

SEQ ID NO: 1613 - RNA, 19 nt, Artificial Sequence
  Description of Artificial Sequence:  synthetic
gaagugcaagaccggcgca

SEQ ID NO: 1614 - RNA, 19 nt, Artificial Sequence
  Description of Artificial Sequence:  synthetic
agccaugacaagcacugcc

SEQ ID NO: 1615 - RNA, 19 nt, Artificial Sequence
  Description of Artificial Sequence:  synthetic
cacaagaaguaccugucgg

SEQ ID NO: 1616 - RNA, 19 nt, Artificial Sequence
  Description of Artificial Sequence:  synthetic
gugcaggcccuggaagccc

SEQ ID NO: 1617 - RNA, 19 nt, Artificial Sequence
  Description of Artificial Sequence:  synthetic
ccucggcucacgcagaacu

SEQ ID NO: 1618 - RNA, 19 nt, Artificial Sequence
  Description of Artificial Sequence:  synthetic
uugaccgaccuccugguga

SEQ ID NO: 1619 - RNA, 19 nt, Artificial Sequence
  Description of Artificial Sequence:  synthetic
aacgugagcgacucgcugg

SEQ ID NO: 1620 - RNA, 19 nt, Artificial Sequence
  Description of Artificial Sequence:  synthetic
gagaugcagugcuuggugg

SEQ ID NO: 1621 - RNA, 19 nt, Artificial Sequence
  Description of Artificial Sequence:  synthetic
gccggagcgcacgcgccca

SEQ ID NO: 1622 - RNA, 19 nt, Artificial Sequence
  Description of Artificial Sequence:  synthetic
agcaucgugugguacaaag

SEQ ID NO: 1623 - RNA, 19 nt, Artificial Sequence
  Description of Artificial Sequence:  synthetic
gacgagaggcugcuggagg

SEQ ID NO: 1624 - RNA, 19 nt, Artificial Sequence
  Description of Artificial Sequence:  synthetic
gaaaagucuggagucgacu

SEQ ID NO: 1625 - RNA, 19 nt, Artificial Sequence
  Description of Artificial Sequence:  synthetic
uuggcggacuccaaccaga

SEQ ID NO: 1626 - RNA, 19 nt, Artificial Sequence
  Description of Artificial Sequence:  synthetic
aagcugagcauccagcgcg

SEQ ID NO: 1627 - RNA, 19 nt, Artificial Sequence
  Description of Artificial Sequence:  synthetic
gugcgcgaggaggaugcgg

SEQ ID NO: 1628 - RNA, 19 nt, Artificial Sequence
  Description of Artificial Sequence:  synthetic
ggaccguaucugugcagcg

SEQ ID NO: 1629 - RNA, 19 nt, Artificial Sequence
  Description of Artificial Sequence:  synthetic
gugugcagacccaagggcu

SEQ ID NO: 1630 - RNA, 19 nt, Artificial Sequence
  Description of Artificial Sequence:  synthetic
ugcgucaacuccuccgcca

SEQ ID NO: 1631 - RNA, 19 nt, Artificial Sequence
  Description of Artificial Sequence:  synthetic
agcguggccguggaaggcu

SEQ ID NO: 1632 - RNA, 19 nt, Artificial Sequence
  Description of Artificial Sequence:  synthetic
uccgaggauaagggcagca

SEQ ID NO: 1633 - RNA, 19 nt, Artificial Sequence
  Description of Artificial Sequence:  synthetic
auggagaucgugauccuug

SEQ ID NO: 1634 - RNA, 19 nt, Artificial Sequence
  Description of Artificial Sequence:  synthetic
gucgguaccggcgucaucg

SEQ ID NO: 1635 - RNA, 19 nt, Artificial Sequence
  Description of Artificial Sequence:  synthetic
gcugucuucuucugggucc

SEQ ID NO: 1636 - RNA, 19 nt, Artificial Sequence
  Description of Artificial Sequence:  synthetic
cuccuccuccucaucuucu

SEQ ID NO: 1637 - RNA, 19 nt, Artificial Sequence
  Description of Artificial Sequence:  synthetic
uguaacaugaggaggccgg

SEQ ID NO: 1638 - RNA, 19 nt, Artificial Sequence
  Description of Artificial Sequence:  synthetic
gcccacgcagacaucaaga

SEQ ID NO: 1639 - RNA, 19 nt, Artificial Sequence
  Description of Artificial Sequence:  synthetic
acgggcuaccuguccauca

SEQ ID NO: 1640 - RNA, 19 nt, Artificial Sequence
  Description of Artificial Sequence:  synthetic
aucauggaccccggggagg

SEQ ID NO: 1641 - RNA, 19 nt, Artificial Sequence
  Description of Artificial Sequence:  synthetic
gugccucuggaggagcaau

SEQ ID NO: 1642 - RNA, 19 nt, Artificial Sequence
  Description of Artificial Sequence:  synthetic
ugcgaauaccuguccuacg

SEQ ID NO: 1643 - RNA, 19 nt, Artificial Sequence
  Description of Artificial Sequence:  synthetic
gaugccagccagugggaau

SEQ ID NO: 1644 - RNA, 19 nt, Artificial Sequence
  Description of Artificial Sequence:  synthetic
uucccccgagagcggcugc

SEQ ID NO: 1645 - RNA, 19 nt, Artificial Sequence
  Description of Artificial Sequence:  synthetic
caccuggggagagugcucg

SEQ ID NO: 1646 - RNA, 19 nt, Artificial Sequence
  Description of Artificial Sequence:  synthetic
ggcuacggcgccuucggga

SEQ ID NO: 1647 - RNA, 19 nt, Artificial Sequence
  Description of Artificial Sequence:  synthetic
aaggugguggaagccuccg

SEQ ID NO: 1648 - RNA, 19 nt, Artificial Sequence
  Description of Artificial Sequence:  synthetic
gcuuucggcauccacaagg

SEQ ID NO: 1649 - RNA, 19 nt, Artificial Sequence
  Description of Artificial Sequence:  synthetic
ggcagcagcugugacaccg

SEQ ID NO: 1650 - RNA, 19 nt, Artificial Sequence
  Description of Artificial Sequence:  synthetic
guggccgugaaaaugcuga

SEQ ID NO: 1651 - RNA, 19 nt, Artificial Sequence
  Description of Artificial Sequence:  synthetic
aaagagggcgccacggcca

SEQ ID NO: 1652 - RNA, 19 nt, Artificial Sequence
  Description of Artificial Sequence:  synthetic
agcgagcagcgcgcgcuga

SEQ ID NO: 1653 - RNA, 19 nt, Artificial Sequence
  Description of Artificial Sequence:  synthetic
augucggagcucaagaucc

SEQ ID NO: 1654 - RNA, 19 nt, Artificial Sequence
  Description of Artificial Sequence:  synthetic
cucauucacaucggcaacc

SEQ ID NO: 1655 - RNA, 19 nt, Artificial Sequence
  Description of Artificial Sequence:  synthetic
caccucaacguggucaacc

SEQ ID NO: 1656 - RNA, 19 nt, Artificial Sequence
  Description of Artificial Sequence:  synthetic
cuccucggggcgugcacca

SEQ ID NO: 1657 - RNA, 19 nt, Artificial Sequence
  Description of Artificial Sequence:  synthetic
aagccgcagggcccccuca

SEQ ID NO: 1658 - RNA, 19 nt, Artificial Sequence
  Description of Artificial Sequence:  synthetic
auggugaucguggaguucu

SEQ ID NO: 1659 - RNA, 19 nt, Artificial Sequence
  Description of Artificial Sequence:  synthetic
ugcaaguacggcaaccucu

SEQ ID NO: 1660 - RNA, 19 nt, Artificial Sequence
  Description of Artificial Sequence:  synthetic
uccaacuuccugcgcgcca

SEQ ID NO: 1661 - RNA, 19 nt, Artificial Sequence
  Description of Artificial Sequence:  synthetic
aagcgggacgccuucagcc

SEQ ID NO: 1662 - RNA, 19 nt, Artificial Sequence
  Description of Artificial Sequence:  synthetic
cccugcgcggagaagucuc

SEQ ID NO: 1663 - RNA, 19 nt, Artificial Sequence
  Description of Artificial Sequence:  synthetic
cccgagcagcgcggacgcu

SEQ ID NO: 1664 - RNA, 19 nt, Artificial Sequence
  Description of Artificial Sequence:  synthetic
uuccgcgccaugguggagc

SEQ ID NO: 1665 - RNA, 19 nt, Artificial Sequence
  Description of Artificial Sequence:  synthetic
cucgccaggcuggaucgga

SEQ ID NO: 1666 - RNA, 19 nt, Artificial Sequence
  Description of Artificial Sequence:  synthetic
aggcggccggggagcagcg

SEQ ID NO: 1667 - RNA, 19 nt, Artificial Sequence
  Description of Artificial Sequence:  synthetic
gacaggguccucuucgcgc

SEQ ID NO: 1668 - RNA, 19 nt, Artificial Sequence
  Description of Artificial Sequence:  synthetic
cgguucucgaagaccgagg

SEQ ID NO: 1669 - RNA, 19 nt, Artificial Sequence
  Description of Artificial Sequence:  synthetic
ggcggagcgaggcgggcuu

SEQ ID NO: 1670 - RNA, 19 nt, Artificial Sequence
  Description of Artificial Sequence:  synthetic
ucuccagaccaagaagcug

SEQ ID NO: 1671 - RNA, 19 nt, Artificial Sequence
  Description of Artificial Sequence:  synthetic
gaggaccuguggcugagcc

SEQ ID NO: 1672 - RNA, 19 nt, Artificial Sequence
  Description of Artificial Sequence:  synthetic
ccgcugaccauggaagauc

SEQ ID NO: 1673 - RNA, 19 nt, Artificial Sequence
  Description of Artificial Sequence:  synthetic
cuugucugcuacagcuucc

SEQ ID NO: 1674 - RNA, 19 nt, Artificial Sequence
  Description of Artificial Sequence:  synthetic
cagguggccagagggaugg

SEQ ID NO: 1675 - RNA, 19 nt, Artificial Sequence
  Description of Artificial Sequence:  synthetic
gaguuccuggcuucccgaa

SEQ ID NO: 1676 - RNA, 19 nt, Artificial Sequence
  Description of Artificial Sequence:  synthetic
aagugcauccacagagacc

SEQ ID NO: 1677 - RNA, 19 nt, Artificial Sequence
  Description of Artificial Sequence:  synthetic
cuggcugcucggaacauuc

SEQ ID NO: 1678 - RNA, 19 nt, Artificial Sequence
  Description of Artificial Sequence:  synthetic
cugcugucggaaagcgacg

SEQ ID NO: 1679 - RNA, 19 nt, Artificial Sequence
  Description of Artificial Sequence:  synthetic
guggugaagaucugugacu

SEQ ID NO: 1680 - RNA, 19 nt, Artificial Sequence
  Description of Artificial Sequence:  synthetic
uuuggccuugcccgggaca

SEQ ID NO: 1681 - RNA, 19 nt, Artificial Sequence
  Description of Artificial Sequence:  synthetic
aucuacaaagaccccgacu

SEQ ID NO: 1682 - RNA, 19 nt, Artificial Sequence
  Description of Artificial Sequence:  synthetic
uacguccgcaagggcagug

SEQ ID NO: 1683 - RNA, 19 nt, Artificial Sequence
  Description of Artificial Sequence:  synthetic
gcccggcugccccugaagu

SEQ ID NO: 1684 - RNA, 19 nt, Artificial Sequence
  Description of Artificial Sequence:  synthetic
uggauggccccugaaagca

SEQ ID NO: 1685 - RNA, 19 nt, Artificial Sequence
  Description of Artificial Sequence:  synthetic
aucuucgacaagguguaca

SEQ ID NO: 1686 - RNA, 19 nt, Artificial Sequence
  Description of Artificial Sequence:  synthetic
accacgcagagugacgugu

SEQ ID NO: 1687 - RNA, 19 nt, Artificial Sequence
  Description of Artificial Sequence:  synthetic
ugguccuuuggggugcuuc

SEQ ID NO: 1688 - RNA, 19 nt, Artificial Sequence
  Description of Artificial Sequence:  synthetic
cucugggagaucuucucuc

SEQ ID NO: 1689 - RNA, 19 nt, Artificial Sequence
  Description of Artificial Sequence:  synthetic
cugggggccuccccguacc

SEQ ID NO: 1690 - RNA, 19 nt, Artificial Sequence
  Description of Artificial Sequence:  synthetic
ccuggggugcagaucaaug

SEQ ID NO: 1691 - RNA, 19 nt, Artificial Sequence
  Description of Artificial Sequence:  synthetic
gaggaguucugccagcgcg

SEQ ID NO: 1692 - RNA, 19 nt, Artificial Sequence
  Description of Artificial Sequence:  synthetic
gugagagacggcacaagga

SEQ ID NO: 1693 - RNA, 19 nt, Artificial Sequence
  Description of Artificial Sequence:  synthetic
augagggccccggagcugg

SEQ ID NO: 1694 - RNA, 19 nt, Artificial Sequence
  Description of Artificial Sequence:  synthetic
gccacucccgccauacgcc

SEQ ID NO: 1695 - RNA, 19 nt, Artificial Sequence
  Description of Artificial Sequence:  synthetic
cacaucaugcugaacugcu

SEQ ID NO: 1696 - RNA, 19 nt, Artificial Sequence
  Description of Artificial Sequence:  synthetic
ugguccggagaccccaagg

SEQ ID NO: 1697 - RNA, 19 nt, Artificial Sequence
  Description of Artificial Sequence:  synthetic
gcgagaccugcauucucgg

SEQ ID NO: 1698 - RNA, 19 nt, Artificial Sequence
  Description of Artificial Sequence:  synthetic
gaccugguggagauccugg

SEQ ID NO: 1699 - RNA, 19 nt, Artificial Sequence
  Description of Artificial Sequence:  synthetic
ggggaccugcuccagggca

SEQ ID NO: 1700 - RNA, 19 nt, Artificial Sequence
  Description of Artificial Sequence:  synthetic
aggggccugcaagaggaag

SEQ ID NO: 1701 - RNA, 19 nt, Artificial Sequence
  Description of Artificial Sequence:  synthetic
gaggaggucugcauggccc

SEQ ID NO: 1702 - RNA, 19 nt, Artificial Sequence
  Description of Artificial Sequence:  synthetic
ccgcgcagcucucagagcu

SEQ ID NO: 1703 - RNA, 19 nt, Artificial Sequence
  Description of Artificial Sequence:  synthetic
ucagaagagggcagcuucu

SEQ ID NO: 1704 - RNA, 19 nt, Artificial Sequence
  Description of Artificial Sequence:  synthetic
ucgcagguguccaccaugg

SEQ ID NO: 1705 - RNA, 19 nt, Artificial Sequence
  Description of Artificial Sequence:  synthetic
gcccuacacaucgcccagg

SEQ ID NO: 1706 - RNA, 19 nt, Artificial Sequence
  Description of Artificial Sequence:  synthetic
gcugacgcugaggacagcc

SEQ ID NO: 1707 - RNA, 19 nt, Artificial Sequence
  Description of Artificial Sequence:  synthetic
ccgccaagccugcagcgcc

SEQ ID NO: 1708 - RNA, 19 nt, Artificial Sequence
  Description of Artificial Sequence:  synthetic
cacagccuggccgccaggu

SEQ ID NO: 1709 - RNA, 19 nt, Artificial Sequence
  Description of Artificial Sequence:  synthetic
uauuacaacuggguguccu

SEQ ID NO: 1710 - RNA, 19 nt, Artificial Sequence
  Description of Artificial Sequence:  synthetic
uuucccgggugccuggcca

SEQ ID NO: 1711 - RNA, 19 nt, Artificial Sequence
  Description of Artificial Sequence:  synthetic
agaggggcugagacccgug

SEQ ID NO: 1712 - RNA, 19 nt, Artificial Sequence
  Description of Artificial Sequence:  synthetic
gguuccuccaggaugaaga

SEQ ID NO: 1713 - RNA, 19 nt, Artificial Sequence
  Description of Artificial Sequence:  synthetic
acauuugaggaauucccca

SEQ ID NO: 1714 - RNA, 19 nt, Artificial Sequence
  Description of Artificial Sequence:  synthetic
augaccccaacgaccuaca

SEQ ID NO: 1715 - RNA, 19 nt, Artificial Sequence
  Description of Artificial Sequence:  synthetic
aaaggcucuguggacaacc

SEQ ID NO: 1716 - RNA, 19 nt, Artificial Sequence
  Description of Artificial Sequence:  synthetic
cagacagacagugggaugg

SEQ ID NO: 1717 - RNA, 19 nt, Artificial Sequence
  Description of Artificial Sequence:  synthetic
gugcuggccucggaggagu

SEQ ID NO: 1718 - RNA, 19 nt, Artificial Sequence
  Description of Artificial Sequence:  synthetic
uuugagcagauagagagca

SEQ ID NO: 1719 - RNA, 19 nt, Artificial Sequence
  Description of Artificial Sequence:  synthetic
aggcauagacaagaaagcg

SEQ ID NO: 1720 - RNA, 19 nt, Artificial Sequence
  Description of Artificial Sequence:  synthetic
ggcuucagguagcugaagc

SEQ ID NO: 1721 - RNA, 19 nt, Artificial Sequence
  Description of Artificial Sequence:  synthetic
cagagagagagaaggcagc

SEQ ID NO: 1722 - RNA, 19 nt, Artificial Sequence
  Description of Artificial Sequence:  synthetic
cauacgucagcauuuucuu

SEQ ID NO: 1723 - RNA, 19 nt, Artificial Sequence
  Description of Artificial Sequence:  synthetic
ucucugcacuuauaagaaa

SEQ ID NO: 1724 - RNA, 19 nt, Artificial Sequence
  Description of Artificial Sequence:  synthetic
agaucaaagacuuuaagac

SEQ ID NO: 1725 - RNA, 19 nt, Artificial Sequence
  Description of Artificial Sequence:  synthetic
cuuucgcuauuucuucuac

SEQ ID NO: 1726 - RNA, 19 nt, Artificial Sequence
  Description of Artificial Sequence:  synthetic
cugcuaucuacuacaaacu

SEQ ID NO: 1727 - RNA, 19 nt, Artificial Sequence
  Description of Artificial Sequence:  synthetic
uucaaagaggaaccaggag

SEQ ID NO: 1728 - RNA, 19 nt, Artificial Sequence
  Description of Artificial Sequence:  synthetic
ggacaagaggagcaugaaa

SEQ ID NO: 1729 - RNA, 19 nt, Artificial Sequence
  Description of Artificial Sequence:  synthetic
aguggacaaggagugugac

SEQ ID NO: 1730 - RNA, 19 nt, Artificial Sequence
  Description of Artificial Sequence:  synthetic
ccacugaagcaccacaggg

SEQ ID NO: 1731 - RNA, 19 nt, Artificial Sequence
  Description of Artificial Sequence:  synthetic
gagggguuaggccuccgga

SEQ ID NO: 1732 - RNA, 19 nt, Artificial Sequence
  Description of Artificial Sequence:  synthetic
augacugcgggcaggccug

SEQ ID NO: 1733 - RNA, 19 nt, Artificial Sequence
  Description of Artificial Sequence:  synthetic
ggauaauauccagccuccc

SEQ ID NO: 1734 - RNA, 19 nt, Artificial Sequence
  Description of Artificial Sequence:  synthetic
cacaagaagcugguggagc

SEQ ID NO: 1735 - RNA, 19 nt, Artificial Sequence
  Description of Artificial Sequence:  synthetic
cagaguguucccugacucc

SEQ ID NO: 1736 - RNA, 19 nt, Artificial Sequence
  Description of Artificial Sequence:  synthetic
cuccaaggaaagggagacg

SEQ ID NO: 1737 - RNA, 19 nt, Artificial Sequence
  Description of Artificial Sequence:  synthetic
gcccuuucauggucugcug

SEQ ID NO: 1738 - RNA, 19 nt, Artificial Sequence
  Description of Artificial Sequence:  synthetic
gaguaacaggugccuuccc

SEQ ID NO: 1739 - RNA, 19 nt, Artificial Sequence
  Description of Artificial Sequence:  synthetic
cagacacuggcguuacugc

SEQ ID NO: 1740 - RNA, 19 nt, Artificial Sequence
  Description of Artificial Sequence:  synthetic
cuugaccaaagagcccuca

SEQ ID NO: 1741 - RNA, 19 nt, Artificial Sequence
  Description of Artificial Sequence:  synthetic
aagcggcccuuaugccagc

SEQ ID NO: 1742 - RNA, 19 nt, Artificial Sequence
  Description of Artificial Sequence:  synthetic
cgugacagagggcucaccu

SEQ ID NO: 1743 - RNA, 19 nt, Artificial Sequence
  Description of Artificial Sequence:  synthetic
ucuugccuucuaggucacu

SEQ ID NO: 1744 - RNA, 19 nt, Artificial Sequence
  Description of Artificial Sequence:  synthetic
uucucacaaugucccuuca

SEQ ID NO: 1745 - RNA, 19 nt, Artificial Sequence
  Description of Artificial Sequence:  synthetic
agcaccugacccugugccc

SEQ ID NO: 1746 - RNA, 19 nt, Artificial Sequence
  Description of Artificial Sequence:  synthetic
cgccgauuauuccuuggua

SEQ ID NO: 1747 - RNA, 19 nt, Artificial Sequence
  Description of Artificial Sequence:  synthetic
aauaugaguaauacaucaa

SEQ ID NO: 1748 - RNA, 19 nt, Artificial Sequence
  Description of Artificial Sequence:  synthetic
aagaguaguauuaaaagcu

SEQ ID NO: 1749 - RNA, 19 nt, Artificial Sequence
  Description of Artificial Sequence:  synthetic
uaauuaaucauguuuauaa

SEQ ID NO: 1750 - RNA, 19 nt, Artificial Sequence
  Description of Artificial Sequence:  synthetic
ccggccgcugcgcgugggu

SEQ ID NO: 1751 - RNA, 19 nt, Artificial Sequence
  Description of Artificial Sequence:  synthetic
cggcgccccgcugcaucuc

SEQ ID NO: 1752 - RNA, 19 nt, Artificial Sequence
  Description of Artificial Sequence:  synthetic
acagucgcaggcacagcgc

SEQ ID NO: 1753 - RNA, 19 nt, Artificial Sequence
  Description of Artificial Sequence:  synthetic
ggagucccaggcagagcca

SEQ ID NO: 1754 - RNA, 19 nt, Artificial Sequence
  Description of Artificial Sequence:  synthetic
cacucaccaggccguccag

SEQ ID NO: 1755 - RNA, 19 nt, Artificial Sequence
  Description of Artificial Sequence:  synthetic
ggggggucauggaguaguc

SEQ ID NO: 1756 - RNA, 19 nt, Artificial Sequence
  Description of Artificial Sequence:  synthetic
ccgugauguucaaggucgg

SEQ ID NO: 1757 - RNA, 19 nt, Artificial Sequence
  Description of Artificial Sequence:  synthetic
cgaugacgugugacuccuc

SEQ ID NO: 1758 - RNA, 19 nt, Artificial Sequence
  Description of Artificial Sequence:  synthetic
acaggcugucaccgguguc

SEQ ID NO: 1759 - RNA, 19 nt, Artificial Sequence
  Description of Artificial Sequence:  synthetic
guccccugcaggagaugga

SEQ ID NO: 1760 - RNA, 19 nt, Artificial Sequence
  Description of Artificial Sequence:  synthetic
cccacucgagggggugcug

SEQ ID NO: 1761 - RNA, 19 nt, Artificial Sequence
  Description of Artificial Sequence:  synthetic
ccugagcuccuggccaagc

SEQ ID NO: 1762 - RNA, 19 nt, Artificial Sequence
  Description of Artificial Sequence:  synthetic
cuccgguggcuggcgccuc

SEQ ID NO: 1763 - RNA, 19 nt, Artificial Sequence
  Description of Artificial Sequence:  synthetic
uguccucgcuguccuuguc

SEQ ID NO: 1764 - RNA, 19 nt, Artificial Sequence
  Description of Artificial Sequence:  synthetic
agucucgcaccacccccgu

SEQ ID NO: 1765 - RNA, 19 nt, Artificial Sequence
  Description of Artificial Sequence:  synthetic
uggcgucugugcccucgca

SEQ ID NO: 1766 - RNA, 19 nt, Artificial Sequence
  Description of Artificial Sequence:  synthetic
acaccuugcaguagggccu

SEQ ID NO: 1767 - RNA, 19 nt, Artificial Sequence
  Description of Artificial Sequence:  synthetic
guaccucgugcagcagcaa

SEQ ID NO: 1768 - RNA, 19 nt, Artificial Sequence
  Description of Artificial Sequence:  synthetic
ugccugugucguuggcaug

SEQ ID NO: 1769 - RNA, 19 nt, Artificial Sequence
  Description of Artificial Sequence:  synthetic
uguaguagcagacguagcu

SEQ ID NO: 1770 - RNA, 19 nt, Artificial Sequence
  Description of Artificial Sequence:  synthetic
ugcgugccuugauguacuu

SEQ ID NO: 1771 - RNA, 19 nt, Artificial Sequence
  Description of Artificial Sequence:  synthetic
cggccguggugcccucgau

SEQ ID NO: 1772 - RNA, 19 nt, Artificial Sequence
  Description of Artificial Sequence:  synthetic
cgaacacguaggagcuggc

SEQ ID NO: 1773 - RNA, 19 nt, Artificial Sequence
  Description of Artificial Sequence:  synthetic
gcugcucaaagucucucac

SEQ ID NO: 1774 - RNA, 19 nt, Artificial Sequence
  Description of Artificial Sequence:  synthetic
caggcuuguugaugaaugg

SEQ ID NO: 1775 - RNA, 19 nt, Artificial Sequence
  Description of Artificial Sequence:  synthetic
uguugaccaagagcguguc

SEQ ID NO: 1776 - RNA, 19 nt, Artificial Sequence
  Description of Artificial Sequence:  synthetic
cccacauggcguccuuccu

SEQ ID NO: 1777 - RNA, 19 nt, Artificial Sequence
  Description of Artificial Sequence:  synthetic
uggacaccagacagggcac

SEQ ID NO: 1778 - RNA, 19 nt, Artificial Sequence
  Description of Artificial Sequence:  synthetic
ugacauugaggccggggau

SEQ ID NO: 1779 - RNA, 19 nt, Artificial Sequence
  Description of Artificial Sequence:  synthetic
agcuuugcgagcgcagcgu

SEQ ID NO: 1780 - RNA, 19 nt, Artificial Sequence
  Description of Artificial Sequence:  synthetic
cgucuggccacagcaccga

SEQ ID NO: 1781 - RNA, 19 nt, Artificial Sequence
  Description of Artificial Sequence:  synthetic
cccacaccaccuccugccc

SEQ ID NO: 1782 - RNA, 19 nt, Artificial Sequence
  Description of Artificial Sequence:  synthetic
gcaugccccgccggucauc

SEQ ID NO: 1783 - RNA, 19 nt, Artificial Sequence
  Description of Artificial Sequence:  synthetic
gcaguggcguggacacgag

SEQ ID NO: 1784 - RNA, 19 nt, Artificial Sequence
  Description of Artificial Sequence:  synthetic
gguacagggcaucgugcag

SEQ ID NO: 1785 - RNA, 19 nt, Artificial Sequence
  Description of Artificial Sequence:  synthetic
agguggucucgcacugcag

SEQ ID NO: 1786 - RNA, 19 nt, Artificial Sequence
  Description of Artificial Sequence:  synthetic
ggaaguccuggucucccca

SEQ ID NO: 1787 - RNA, 19 nt, Artificial Sequence
  Description of Artificial Sequence:  synthetic
ccaggaagggguuggaaag

SEQ ID NO: 1788 - RNA, 19 nt, Artificial Sequence
  Description of Artificial Sequence:  synthetic
cguugccugugaugugcac

SEQ ID NO: 1789 - RNA, 19 nt, Artificial Sequence
  Description of Artificial Sequence:  synthetic
gcuggaugucauagagcuc

SEQ ID NO: 1790 - RNA, 19 nt, Artificial Sequence
  Description of Artificial Sequence:  synthetic
gcgacuuccugggcaacag

SEQ ID NO: 1791 - RNA, 19 nt, Artificial Sequence
  Description of Artificial Sequence:  synthetic
ccccuaccagcagcuccag

SEQ ID NO: 1792 - RNA, 19 nt, Artificial Sequence
  Description of Artificial Sequence:  synthetic
aguugaggaccagcuucuc

SEQ ID NO: 1793 - RNA, 19 nt, Artificial Sequence
  Description of Artificial Sequence:  synthetic
acucagcccacacggugca

SEQ ID NO: 1794 - RNA, 19 nt, Artificial Sequence
  Description of Artificial Sequence:  synthetic
aggugacaccugaguuaaa

SEQ ID NO: 1795 - RNA, 19 nt, Artificial Sequence
  Description of Artificial Sequence:  synthetic
cuggguagucccagucaaa

SEQ ID NO: 1796 - RNA, 19 nt, Artificial Sequence
  Description of Artificial Sequence:  synthetic
cccgcucugccugcuuccc

SEQ ID NO: 1797 - RNA, 19 nt, Artificial Sequence
  Description of Artificial Sequence:  synthetic
gcucgggcacccacuuacc

SEQ ID NO: 1798 - RNA, 19 nt, Artificial Sequence
  Description of Artificial Sequence:  synthetic
gggucuguugggagcgucg

SEQ ID NO: 1799 - RNA, 19 nt, Artificial Sequence
  Description of Artificial Sequence:  synthetic
ugcuggagaguucugugug

SEQ ID NO: 1800 - RNA, 19 nt, Artificial Sequence
  Description of Artificial Sequence:  synthetic
cguuguggauggucaggau

SEQ ID NO: 1801 - RNA, 19 nt, Artificial Sequence
  Description of Artificial Sequence:  synthetic
ccaggucgugcuggcugac

SEQ ID NO: 1802 - RNA, 19 nt, Artificial Sequence
  Description of Artificial Sequence:  synthetic
ccuugcacacauacgagcc

SEQ ID NO: 1803 - RNA, 19 nt, Artificial Sequence
  Description of Artificial Sequence:  synthetic
gcuggaugccguuguuggc

SEQ ID NO: 1804 - RNA, 19 nt, Artificial Sequence
  Description of Artificial Sequence:  synthetic
cggugcucucccgaaaucg

SEQ ID NO: 1805 - RNA, 19 nt, Artificial Sequence
  Description of Artificial Sequence:  synthetic
uuucaugcacaaugaccuc

SEQ ID NO: 1806 - RNA, 19 nt, Artificial Sequence
  Description of Artificial Sequence:  synthetic
cgacgcugaugaagggauu

SEQ ID NO: 1807 - RNA, 19 nt, Artificial Sequence
  Description of Artificial Sequence:  synthetic
uggguccuuugagccacuc

SEQ ID NO: 1808 - RNA, 19 nt, Artificial Sequence
  Description of Artificial Sequence:  synthetic
cugccguggccuccaggau

SEQ ID NO: 1809 - RNA, 19 nt, Artificial Sequence
  Description of Artificial Sequence:  synthetic
gcuucaccagcucgucucc

SEQ ID NO: 1810 - RNA, 19 nt, Artificial Sequence
  Description of Artificial Sequence:  synthetic
cugccagcuucacgggcag

SEQ ID NO: 1811 - RNA, 19 nt, Artificial Sequence
  Description of Artificial Sequence:  synthetic
acucgggcgggggguacgc

SEQ ID NO: 1812 - RNA, 19 nt, Artificial Sequence
  Description of Artificial Sequence:  synthetic
cauccuuguaccacuggaa

SEQ ID NO: 1813 - RNA, 19 nt, Artificial Sequence
  Description of Artificial Sequence:  synthetic
gcccggacagugccuuucc

SEQ ID NO: 1814 - RNA, 19 nt, Artificial Sequence
  Description of Artificial Sequence:  synthetic
gggcauguggacuguggcg

SEQ ID NO: 1815 - RNA, 19 nt, Artificial Sequence
  Description of Artificial Sequence:  synthetic
ucaccuccuugagcaccag

SEQ ID NO: 1816 - RNA, 19 nt, Artificial Sequence
  Description of Artificial Sequence:  synthetic
ugccugugcuggccucugu

SEQ ID NO: 1817 - RNA, 19 nt, Artificial Sequence
  Description of Artificial Sequence:  synthetic
acagggcgaggguguaggu

SEQ ID NO: 1818 - RNA, 19 nt, Artificial Sequence
  Description of Artificial Sequence:  synthetic
ggccagcagcggaguucca

SEQ ID NO: 1819 - RNA, 19 nt, Artificial Sequence
  Description of Artificial Sequence:  synthetic
ggcugauguugcgccucag

SEQ ID NO: 1820 - RNA, 19 nt, Artificial Sequence
  Description of Artificial Sequence:  synthetic
cauucaccaccagcuccag

SEQ ID NO: 1821 - RNA, 19 nt, Artificial Sequence
  Description of Artificial Sequence:  synthetic
cauguaucugggggggcac

SEQ ID NO: 1822 - RNA, 19 nt, Artificial Sequence
  Description of Artificial Sequence:  synthetic
gggaggaggccuccuucuc

SEQ ID NO: 1823 - RNA, 19 nt, Artificial Sequence
  Description of Artificial Sequence:  synthetic
gacgcgaguagaugcuggg

SEQ ID NO: 1824 - RNA, 19 nt, Artificial Sequence
  Description of Artificial Sequence:  synthetic
ugagggccuggcggcugug

SEQ ID NO: 1825 - RNA, 19 nt, Artificial Sequence
  Description of Artificial Sequence:  synthetic
ccccguaggccgugcaggu

SEQ ID NO: 1826 - RNA, 19 nt, Artificial Sequence
  Description of Artificial Sequence:  synthetic
ugcugagaggcaggggcac

SEQ ID NO: 1827 - RNA, 19 nt, Artificial Sequence
  Description of Artificial Sequence:  synthetic
gccgccagugccacuggau

SEQ ID NO: 1828 - RNA, 19 nt, Artificial Sequence
  Description of Artificial Sequence:  synthetic
ucuugcaggguguccaggg

SEQ ID NO: 1829 - RNA, 19 nt, Artificial Sequence
  Description of Artificial Sequence:  synthetic
gacuacgcugggcaaacau

SEQ ID NO: 1830 - RNA, 19 nt, Artificial Sequence
  Description of Artificial Sequence:  synthetic
gcugcugccgccgccggag

SEQ ID NO: 1831 - RNA, 19 nt, Artificial Sequence
  Description of Artificial Sequence:  synthetic
acuguggcaugaggucuug

SEQ ID NO: 1832 - RNA, 19 nt, Artificial Sequence
  Description of Artificial Sequence:  synthetic
ccgcccuccagucacggca

SEQ ID NO: 1833 - RNA, 19 nt, Artificial Sequence
  Description of Artificial Sequence:  synthetic
cggcauccugcguggucac

SEQ ID NO: 1834 - RNA, 19 nt, Artificial Sequence
  Description of Artificial Sequence:  synthetic
ggcucucgaugggguucac

SEQ ID NO: 1835 - RNA, 19 nt, Artificial Sequence
  Description of Artificial Sequence:  synthetic
acucgguccagguguccag

SEQ ID NO: 1836 - RNA, 19 nt, Artificial Sequence
  Description of Artificial Sequence:  synthetic
uauucuuucccuccacaaa

SEQ ID NO: 1837 - RNA, 19 nt, Artificial Sequence
  Description of Artificial Sequence:  synthetic
ccagcuugcucacagucuu

SEQ ID NO: 1838 - RNA, 19 nt, Artificial Sequence
  Description of Artificial Sequence:  synthetic
cguuggcauucuggaucac

SEQ ID NO: 1839 - RNA, 19 nt, Artificial Sequence
  Description of Artificial Sequence:  synthetic
acuuguacauggcagacac

SEQ ID NO: 1840 - RNA, 19 nt, Artificial Sequence
  Description of Artificial Sequence:  synthetic
ccuuguuggagaccacaca

SEQ ID NO: 1841 - RNA, 19 nt, Artificial Sequence
  Description of Artificial Sequence:  synthetic
gccgcucauccuggcccac

SEQ ID NO: 1842 - RNA, 19 nt, Artificial Sequence
  Description of Artificial Sequence:  synthetic
ucacauagaaguagaugag

SEQ ID NO: 1843 - RNA, 19 nt, Artificial Sequence
  Description of Artificial Sequence:  synthetic
agccgucggggaugguggu

SEQ ID NO: 1844 - RNA, 19 nt, Artificial Sequence
  Description of Artificial Sequence:  synthetic
gcuuggauucgauggugaa

SEQ ID NO: 1845 - RNA, 19 nt, Artificial Sequence
  Description of Artificial Sequence:  synthetic
cuaguagcuccucggaugg

SEQ ID NO: 1846 - RNA, 19 nt, Artificial Sequence
  Description of Artificial Sequence:  synthetic
ggagcaccggcuggcccuc

SEQ ID NO: 1847 - RNA, 19 nt, Artificial Sequence
  Description of Artificial Sequence:  synthetic
ugucggcuuggcagcucag

SEQ ID NO: 1848 - RNA, 19 nt, Artificial Sequence
  Description of Artificial Sequence:  synthetic
gaugcucguacuuguagcu

SEQ ID NO: 1849 - RNA, 19 nt, Artificial Sequence
  Description of Artificial Sequence:  synthetic
ugaggcgguaccagcgcag

SEQ ID NO: 1850 - RNA, 19 nt, Artificial Sequence
  Description of Artificial Sequence:  synthetic
cgugcagcguggacagguu

SEQ ID NO: 1851 - RNA, 19 nt, Artificial Sequence
  Description of Artificial Sequence:  synthetic
gcggguucccgugcgcauc

SEQ ID NO: 1852 - RNA, 19 nt, Artificial Sequence
  Description of Artificial Sequence:  synthetic
ucuugcagucgagcagaag

SEQ ID NO: 1853 - RNA, 19 nt, Artificial Sequence
  Description of Artificial Sequence:  synthetic
uggcgaacagaugcacguu

SEQ ID NO: 1854 - RNA, 19 nt, Artificial Sequence
  Description of Artificial Sequence:  synthetic
ggcuggcggccagaggggu

SEQ ID NO: 1855 - RNA, 19 nt, Artificial Sequence
  Description of Artificial Sequence:  synthetic
caggugccaccuccuccag

SEQ ID NO: 1856 - RNA, 19 nt, Artificial Sequence
  Description of Artificial Sequence:  synthetic
gcguggcguggcgcgcccc

SEQ ID NO: 1857 - RNA, 19 nt, Artificial Sequence
  Description of Artificial Sequence:  synthetic
gggggauacucaggcugag

SEQ ID NO: 1858 - RNA, 19 nt, Artificial Sequence
  Description of Artificial Sequence:  synthetic
cgugcucgggcgcgacgcg

SEQ ID NO: 1859 - RNA, 19 nt, Artificial Sequence
  Description of Artificial Sequence:  synthetic
cgcacacauaguggcccuc

SEQ ID NO: 1860 - RNA, 19 nt, Artificial Sequence
  Description of Artificial Sequence:  synthetic
ugcgccggucuugcacuuc

SEQ ID NO: 1861 - RNA, 19 nt, Artificial Sequence
  Description of Artificial Sequence:  synthetic
ggcagugcuugucauggcu

SEQ ID NO: 1862 - RNA, 19 nt, Artificial Sequence
  Description of Artificial Sequence:  synthetic
ccgacagguacuucuugug

SEQ ID NO: 1863 - RNA, 19 nt, Artificial Sequence
  Description of Artificial Sequence:  synthetic
gggcuuccagggccugcac

SEQ ID NO: 1864 - RNA, 19 nt, Artificial Sequence
  Description of Artificial Sequence:  synthetic
aguucugcgugagccgagg

SEQ ID NO: 1865 - RNA, 19 nt, Artificial Sequence
  Description of Artificial Sequence:  synthetic
ucaccaggaggucggucaa

SEQ ID NO: 1866 - RNA, 19 nt, Artificial Sequence
  Description of Artificial Sequence:  synthetic
ccagcgagucgcucacguu

SEQ ID NO: 1867 - RNA, 19 nt, Artificial Sequence
  Description of Artificial Sequence:  synthetic
ccaccaagcacugcaucuc

SEQ ID NO: 1868 - RNA, 19 nt, Artificial Sequence
  Description of Artificial Sequence:  synthetic
ugggcgcgugcgcuccggc

SEQ ID NO: 1869 - RNA, 19 nt, Artificial Sequence
  Description of Artificial Sequence:  synthetic
cuuuguaccacacgaugcu

SEQ ID NO: 1870 - RNA, 19 nt, Artificial Sequence
  Description of Artificial Sequence:  synthetic
ccuccagcagccucucguc

SEQ ID NO: 1871 - RNA, 19 nt, Artificial Sequence
  Description of Artificial Sequence:  synthetic
agucgacuccagacuuuuc

SEQ ID NO: 1872 - RNA, 19 nt, Artificial Sequence
  Description of Artificial Sequence:  synthetic
ucugguuggaguccgccaa

SEQ ID NO: 1873 - RNA, 19 nt, Artificial Sequence
  Description of Artificial Sequence:  synthetic
cgcgcuggaugcucagcuu

SEQ ID NO: 1874 - RNA, 19 nt, Artificial Sequence
  Description of Artificial Sequence:  synthetic
ccgcauccuccucgcgcac

SEQ ID NO: 1875 - RNA, 19 nt, Artificial Sequence
  Description of Artificial Sequence:  synthetic
cgcugcacagauacggucc

SEQ ID NO: 1876 - RNA, 19 nt, Artificial Sequence
  Description of Artificial Sequence:  synthetic
agcccuugggucugcacac

SEQ ID NO: 1877 - RNA, 19 nt, Artificial Sequence
  Description of Artificial Sequence:  synthetic
uggcggaggaguugacgca

SEQ ID NO: 1878 - RNA, 19 nt, Artificial Sequence
  Description of Artificial Sequence:  synthetic
agccuuccacggccacgcu

SEQ ID NO: 1879 - RNA, 19 nt, Artificial Sequence
  Description of Artificial Sequence:  synthetic
ugcugcccuuauccucgga

SEQ ID NO: 1880 - RNA, 19 nt, Artificial Sequence
  Description of Artificial Sequence:  synthetic
caaggaucacgaucuccau

SEQ ID NO: 1881 - RNA, 19 nt, Artificial Sequence
  Description of Artificial Sequence:  synthetic
cgaugacgccgguaccgac

SEQ ID NO: 1882 - RNA, 19 nt, Artificial Sequence
  Description of Artificial Sequence:  synthetic
ggacccagaagaagacagc

SEQ ID NO: 1883 - RNA, 19 nt, Artificial Sequence
  Description of Artificial Sequence:  synthetic
agaagaugaggaggaggag

SEQ ID NO: 1884 - RNA, 19 nt, Artificial Sequence
  Description of Artificial Sequence:  synthetic
ccggccuccucauguuaca

SEQ ID NO: 1885 - RNA, 19 nt, Artificial Sequence
  Description of Artificial Sequence:  synthetic
ucuugaugucugcgugggc

SEQ ID NO: 1886 - RNA, 19 nt, Artificial Sequence
  Description of Artificial Sequence:  synthetic
ugauggacagguagcccgu

SEQ ID NO: 1887 - RNA, 19 nt, Artificial Sequence
  Description of Artificial Sequence:  synthetic
ccuccccgggguccaugau

SEQ ID NO: 1888 - RNA, 19 nt, Artificial Sequence
  Description of Artificial Sequence:  synthetic
auugcuccuccagaggcac

SEQ ID NO: 1889 - RNA, 19 nt, Artificial Sequence
  Description of Artificial Sequence:  synthetic
cguaggacagguauucgca

SEQ ID NO: 1890 - RNA, 19 nt, Artificial Sequence
  Description of Artificial Sequence:  synthetic
auucccacuggcuggcauc

SEQ ID NO: 1891 - RNA, 19 nt, Artificial Sequence
  Description of Artificial Sequence:  synthetic
gcagccgcucucgggggaa

SEQ ID NO: 1892 - RNA, 19 nt, Artificial Sequence
  Description of Artificial Sequence:  synthetic
cgagcacucuccccaggug

SEQ ID NO: 1893 - RNA, 19 nt, Artificial Sequence
  Description of Artificial Sequence:  synthetic
ucccgaaggcgccguagcc

SEQ ID NO: 1894 - RNA, 19 nt, Artificial Sequence
  Description of Artificial Sequence:  synthetic
cggaggcuuccaccaccuu

SEQ ID NO: 1895 - RNA, 19 nt, Artificial Sequence
  Description of Artificial Sequence:  synthetic
ccuuguggaugccgaaagc

SEQ ID NO: 1896 - RNA, 19 nt, Artificial Sequence
  Description of Artificial Sequence:  synthetic
cggugucacagcugcugcc

SEQ ID NO: 1897 - RNA, 19 nt, Artificial Sequence
  Description of Artificial Sequence:  synthetic
ucagcauuuucacggccac

SEQ ID NO: 1898 - RNA, 19 nt, Artificial Sequence
  Description of Artificial Sequence:  synthetic
uggccguggcgcccucuuu

SEQ ID NO: 1899 - RNA, 19 nt, Artificial Sequence
  Description of Artificial Sequence:  synthetic
ucagcgcgcgcugcucgcu

SEQ ID NO: 1900 - RNA, 19 nt, Artificial Sequence
  Description of Artificial Sequence:  synthetic
ggaucuugagcuccgacau

SEQ ID NO: 1901 - RNA, 19 nt, Artificial Sequence
  Description of Artificial Sequence:  synthetic
gguugccgaugugaaugag

SEQ ID NO: 1902 - RNA, 19 nt, Artificial Sequence
  Description of Artificial Sequence:  synthetic
gguugaccacguugaggug

SEQ ID NO: 1903 - RNA, 19 nt, Artificial Sequence
  Description of Artificial Sequence:  synthetic
uggugcacgccccgaggag

SEQ ID NO: 1904 - RNA, 19 nt, Artificial Sequence
  Description of Artificial Sequence:  synthetic
ugagggggcccugcggcuu

SEQ ID NO: 1905 - RNA, 19 nt, Artificial Sequence
  Description of Artificial Sequence:  synthetic
agaacuccacgaucaccau

SEQ ID NO: 1906 - RNA, 19 nt, Artificial Sequence
  Description of Artificial Sequence:  synthetic
agagguugccguacuugca

SEQ ID NO: 1907 - RNA, 19 nt, Artificial Sequence
  Description of Artificial Sequence:  synthetic
uggcgcgcaggaaguugga

SEQ ID NO: 1908 - RNA, 19 nt, Artificial Sequence
  Description of Artificial Sequence:  synthetic
ggcugaaggcgucccgcuu

SEQ ID NO: 1909 - RNA, 19 nt, Artificial Sequence
  Description of Artificial Sequence:  synthetic
gagacuucuccgcgcaggg

SEQ ID NO: 1910 - RNA, 19 nt, Artificial Sequence
  Description of Artificial Sequence:  synthetic
agcguccgcgcugcucggg

SEQ ID NO: 1911 - RNA, 19 nt, Artificial Sequence
  Description of Artificial Sequence:  synthetic
gcuccaccauggcgcggaa

SEQ ID NO: 1912 - RNA, 19 nt, Artificial Sequence
  Description of Artificial Sequence:  synthetic
uccgauccagccuggcgag

SEQ ID NO: 1913 - RNA, 19 nt, Artificial Sequence
  Description of Artificial Sequence:  synthetic
cgcugcuccccggccgccu

SEQ ID NO: 1914 - RNA, 19 nt, Artificial Sequence
  Description of Artificial Sequence:  synthetic
gcgcgaagaggacccuguc

SEQ ID NO: 1915 - RNA, 19 nt, Artificial Sequence
  Description of Artificial Sequence:  synthetic
ccucggucuucgagaaccg

SEQ ID NO: 1916 - RNA, 19 nt, Artificial Sequence
  Description of Artificial Sequence:  synthetic
aagcccgccucgcuccgcc

SEQ ID NO: 1917 - RNA, 19 nt, Artificial Sequence
  Description of Artificial Sequence:  synthetic
cagcuucuuggucuggaga

SEQ ID NO: 1918 - RNA, 19 nt, Artificial Sequence
  Description of Artificial Sequence:  synthetic
ggcucagccacagguccuc

SEQ ID NO: 1919 - RNA, 19 nt, Artificial Sequence
  Description of Artificial Sequence:  synthetic
gaucuuccauggucagcgg

SEQ ID NO: 1920 - RNA, 19 nt, Artificial Sequence
  Description of Artificial Sequence:  synthetic
ggaagcuguagcagacaag

SEQ ID NO: 1921 - RNA, 19 nt, Artificial Sequence
  Description of Artificial Sequence:  synthetic
ccaucccucuggccaccug

SEQ ID NO: 1922 - RNA, 19 nt, Artificial Sequence
  Description of Artificial Sequence:  synthetic
uucgggaagccaggaacuc

SEQ ID NO: 1923 - RNA, 19 nt, Artificial Sequence
  Description of Artificial Sequence:  synthetic
ggucucuguggaugcacuu

SEQ ID NO: 1924 - RNA, 19 nt, Artificial Sequence
  Description of Artificial Sequence:  synthetic
gaauguuccgagcagccag

SEQ ID NO: 1925 - RNA, 19 nt, Artificial Sequence
  Description of Artificial Sequence:  synthetic
cgucgcuuuccgacagcag

SEQ ID NO: 1926 - RNA, 19 nt, Artificial Sequence
  Description of Artificial Sequence:  synthetic
agucacagaucuucaccac

SEQ ID NO: 1927 - RNA, 19 nt, Artificial Sequence
  Description of Artificial Sequence:  synthetic
ugucccgggcaaggccaaa

SEQ ID NO: 1928 - RNA, 19 nt, Artificial Sequence
  Description of Artificial Sequence:  synthetic
agucggggucuuuguagau

SEQ ID NO: 1929 - RNA, 19 nt, Artificial Sequence
  Description of Artificial Sequence:  synthetic
cacugcccuugcggacgua

SEQ ID NO: 1930 - RNA, 19 nt, Artificial Sequence
  Description of Artificial Sequence:  synthetic
acuucaggggcagccgggc

SEQ ID NO: 1931 - RNA, 19 nt, Artificial Sequence
  Description of Artificial Sequence:  synthetic
ugcuuucaggggccaucca

SEQ ID NO: 1932 - RNA, 19 nt, Artificial Sequence
  Description of Artificial Sequence:  synthetic
uguacaccuugucgaagau

SEQ ID NO: 1933 - RNA, 19 nt, Artificial Sequence
  Description of Artificial Sequence:  synthetic
acacgucacucugcguggu

SEQ ID NO: 1934 - RNA, 19 nt, Artificial Sequence
  Description of Artificial Sequence:  synthetic
gaagcaccccaaaggacca

SEQ ID NO: 1935 - RNA, 19 nt, Artificial Sequence
  Description of Artificial Sequence:  synthetic
gagagaagaucucccagag

SEQ ID NO: 1936 - RNA, 19 nt, Artificial Sequence
  Description of Artificial Sequence:  synthetic
gguacggggaggcccccag

SEQ ID NO: 1937 - RNA, 19 nt, Artificial Sequence
  Description of Artificial Sequence:  synthetic
cauugaucugcaccccagg

SEQ ID NO: 1938 - RNA, 19 nt, Artificial Sequence
  Description of Artificial Sequence:  synthetic
cgcgcuggcagaacuccuc

SEQ ID NO: 1939 - RNA, 19 nt, Artificial Sequence
  Description of Artificial Sequence:  synthetic
uccuugugccgucucucac

SEQ ID NO: 1940 - RNA, 19 nt, Artificial Sequence
  Description of Artificial Sequence:  synthetic
ccagcuccggggcccucau

SEQ ID NO: 1941 - RNA, 19 nt, Artificial Sequence
  Description of Artificial Sequence:  synthetic
ggcguauggcgggaguggc

SEQ ID NO: 1942 - RNA, 19 nt, Artificial Sequence
  Description of Artificial Sequence:  synthetic
agcaguucagcaugaugug

SEQ ID NO: 1943 - RNA, 19 nt, Artificial Sequence
  Description of Artificial Sequence:  synthetic
ccuuggggucuccggacca

SEQ ID NO: 1944 - RNA, 19 nt, Artificial Sequence
  Description of Artificial Sequence:  synthetic
ccgagaaugcaggucucgc

SEQ ID NO: 1945 - RNA, 19 nt, Artificial Sequence
  Description of Artificial Sequence:  synthetic
ccaggaucuccaccagguc

SEQ ID NO: 1946 - RNA, 19 nt, Artificial Sequence
  Description of Artificial Sequence:  synthetic
ugcccuggagcaggucccc

SEQ ID NO: 1947 - RNA, 19 nt, Artificial Sequence
  Description of Artificial Sequence:  synthetic
cuuccucuugcaggccccu

SEQ ID NO: 1948 - RNA, 19 nt, Artificial Sequence
  Description of Artificial Sequence:  synthetic
gggccaugcagaccuccuc

SEQ ID NO: 1949 - RNA, 19 nt, Artificial Sequence
  Description of Artificial Sequence:  synthetic
agcucugagagcugcgcgg

SEQ ID NO: 1950 - RNA, 19 nt, Artificial Sequence
  Description of Artificial Sequence:  synthetic
agaagcugcccucuucuga

SEQ ID NO: 1951 - RNA, 19 nt, Artificial Sequence
  Description of Artificial Sequence:  synthetic
ccaugguggacaccugcga

SEQ ID NO: 1952 - RNA, 19 nt, Artificial Sequence
  Description of Artificial Sequence:  synthetic
ccugggcgauguguagggc

SEQ ID NO: 1953 - RNA, 19 nt, Artificial Sequence
  Description of Artificial Sequence:  synthetic
ggcuguccucagcgucagc

SEQ ID NO: 1954 - RNA, 19 nt, Artificial Sequence
  Description of Artificial Sequence:  synthetic
ggcgcugcaggcuuggcgg

SEQ ID NO: 1955 - RNA, 19 nt, Artificial Sequence
  Description of Artificial Sequence:  synthetic
accuggcggccaggcugug

SEQ ID NO: 1956 - RNA, 19 nt, Artificial Sequence
  Description of Artificial Sequence:  synthetic
aggacacccaguuguaaua

SEQ ID NO: 1957 - RNA, 19 nt, Artificial Sequence
  Description of Artificial Sequence:  synthetic
uggccaggcacccgggaaa

SEQ ID NO: 1958 - RNA, 19 nt, Artificial Sequence
  Description of Artificial Sequence:  synthetic
cacgggucucagccccucu

SEQ ID NO: 1959 - RNA, 19 nt, Artificial Sequence
  Description of Artificial Sequence:  synthetic
ucuucauccuggaggaacc

SEQ ID NO: 1960 - RNA, 19 nt, Artificial Sequence
  Description of Artificial Sequence:  synthetic
uggggaauuccucaaaugu

SEQ ID NO: 1961 - RNA, 19 nt, Artificial Sequence
  Description of Artificial Sequence:  synthetic
uguaggucguuggggucau

SEQ ID NO: 1962 - RNA, 19 nt, Artificial Sequence
  Description of Artificial Sequence:  synthetic
gguuguccacagagccuuu

SEQ ID NO: 1963 - RNA, 19 nt, Artificial Sequence
  Description of Artificial Sequence:  synthetic
ccaucccacugucugucug

SEQ ID NO: 1964 - RNA, 19 nt, Artificial Sequence
  Description of Artificial Sequence:  synthetic
acuccuccgaggccagcac

SEQ ID NO: 1965 - RNA, 19 nt, Artificial Sequence
  Description of Artificial Sequence:  synthetic
ugcucucuaucugcucaaa

SEQ ID NO: 1966 - RNA, 19 nt, Artificial Sequence
  Description of Artificial Sequence:  synthetic
cgcuuucuugucuaugccu

SEQ ID NO: 1967 - RNA, 19 nt, Artificial Sequence
  Description of Artificial Sequence:  synthetic
gcuucagcuaccugaagcc

SEQ ID NO: 1968 - RNA, 19 nt, Artificial Sequence
  Description of Artificial Sequence:  synthetic
gcugccuucucucucucug

SEQ ID NO: 1969 - RNA, 19 nt, Artificial Sequence
  Description of Artificial Sequence:  synthetic
aagaaaaugcugacguaug

SEQ ID NO: 1970 - RNA, 19 nt, Artificial Sequence
  Description of Artificial Sequence:  synthetic
uuucuuauaagugcagaga

SEQ ID NO: 1971 - RNA, 19 nt, Artificial Sequence
  Description of Artificial Sequence:  synthetic
gucuuaaagucuuugaucu

SEQ ID NO: 1972 - RNA, 19 nt, Artificial Sequence
  Description of Artificial Sequence:  synthetic
guagaagaaauagcgaaag

SEQ ID NO: 1973 - RNA, 19 nt, Artificial Sequence
  Description of Artificial Sequence:  synthetic
aguuuguaguagauagcag

SEQ ID NO: 1974 - RNA, 19 nt, Artificial Sequence
  Description of Artificial Sequence:  synthetic
cuccugguuccucuuugaa

SEQ ID NO: 1975 - RNA, 19 nt, Artificial Sequence
  Description of Artificial Sequence:  synthetic
uuucaugcuccucuugucc

SEQ ID NO: 1976 - RNA, 19 nt, Artificial Sequence
  Description of Artificial Sequence:  synthetic
gucacacuccuuguccacu

SEQ ID NO: 1977 - RNA, 19 nt, Artificial Sequence
  Description of Artificial Sequence:  synthetic
cccuguggugcuucagugg

SEQ ID NO: 1978 - RNA, 19 nt, Artificial Sequence
  Description of Artificial Sequence:  synthetic
uccggaggccuaaccccuc

SEQ ID NO: 1979 - RNA, 19 nt, Artificial Sequence
  Description of Artificial Sequence:  synthetic
caggccugcccgcagucau

SEQ ID NO: 1980 - RNA, 19 nt, Artificial Sequence
  Description of Artificial Sequence:  synthetic
gggaggcuggauauuaucc

SEQ ID NO: 1981 - RNA, 19 nt, Artificial Sequence
  Description of Artificial Sequence:  synthetic
gcuccaccagcuucuugug

SEQ ID NO: 1982 - RNA, 19 nt, Artificial Sequence
  Description of Artificial Sequence:  synthetic
ggagucagggaacacucug

SEQ ID NO: 1983 - RNA, 19 nt, Artificial Sequence
  Description of Artificial Sequence:  synthetic
cgucucccuuuccuuggag

SEQ ID NO: 1984 - RNA, 19 nt, Artificial Sequence
  Description of Artificial Sequence:  synthetic
cagcagaccaugaaagggc

SEQ ID NO: 1985 - RNA, 19 nt, Artificial Sequence
  Description of Artificial Sequence:  synthetic
gggaaggcaccuguuacuc

SEQ ID NO: 1986 - RNA, 19 nt, Artificial Sequence
  Description of Artificial Sequence:  synthetic
gcaguaacgccagugucug

SEQ ID NO: 1987 - RNA, 19 nt, Artificial Sequence
  Description of Artificial Sequence:  synthetic
ugagggcucuuuggucaag

SEQ ID NO: 1988 - RNA, 19 nt, Artificial Sequence
  Description of Artificial Sequence:  synthetic
gcuggcauaagggccgcuu

SEQ ID NO: 1989 - RNA, 19 nt, Artificial Sequence
  Description of Artificial Sequence:  synthetic
aggugagcccucugucacg

SEQ ID NO: 1990 - RNA, 19 nt, Artificial Sequence
  Description of Artificial Sequence:  synthetic
agugaccuagaaggcaaga

SEQ ID NO: 1991 - RNA, 19 nt, Artificial Sequence
  Description of Artificial Sequence:  synthetic
ugaagggacauugugagaa

SEQ ID NO: 1992 - RNA, 19 nt, Artificial Sequence
  Description of Artificial Sequence:  synthetic
gggcacagggucaggugcu

SEQ ID NO: 1993 - RNA, 19 nt, Artificial Sequence
  Description of Artificial Sequence:  synthetic
uaccaaggaauaaucggcg

SEQ ID NO: 1994 - RNA, 19 nt, Artificial Sequence
  Description of Artificial Sequence:  synthetic
uugauguauuacucauauu

SEQ ID NO: 1995 - RNA, 19 nt, Artificial Sequence
  Description of Artificial Sequence:  synthetic
agcuuuuaauacuacucuu

SEQ ID NO: 1996 - RNA, 19 nt, Artificial Sequence
  Description of Artificial Sequence:  synthetic
uuauaaacaugauuaauua

SEQ ID NO: 1997 - RNA, 19 nt, Artificial Sequence
  Description of Artificial Sequence:  synthetic
gcggaggcuuggggcagcc

SEQ ID NO: 1998 - RNA, 19 nt, Artificial Sequence
  Description of Artificial Sequence:  synthetic
cggguagcucggaggucgu

SEQ ID NO: 1999 - RNA, 19 nt, Artificial Sequence
  Description of Artificial Sequence:  synthetic
uggcgcugggggcuagcac

SEQ ID NO: 2000 - RNA, 19 nt, Artificial Sequence
  Description of Artificial Sequence:  synthetic
ccagcgcucugucgggagg

SEQ ID NO: 2001 - RNA, 19 nt, Artificial Sequence
  Description of Artificial Sequence:  synthetic
gcgcagcgguuagguggac

SEQ ID NO: 2002 - RNA, 19 nt, Artificial Sequence
  Description of Artificial Sequence:  synthetic
ccggucagcggacucaccg

SEQ ID NO: 2003 - RNA, 19 nt, Artificial Sequence
  Description of Artificial Sequence:  synthetic
ggccagggcgcucggugcu

SEQ ID NO: 2004 - RNA, 19 nt, Artificial Sequence
  Description of Artificial Sequence:  synthetic
uggaauuugauauucauug

SEQ ID NO: 2005 - RNA, 19 nt, Artificial Sequence
  Description of Artificial Sequence:  synthetic
gauccggguuuuaucccuc

SEQ ID NO: 2006 - RNA, 19 nt, Artificial Sequence
  Description of Artificial Sequence:  synthetic
cuucuuuuuucuuaaacau

SEQ ID NO: 2007 - RNA, 19 nt, Artificial Sequence
  Description of Artificial Sequence:  synthetic
uuuuuuuuuaaaacuguau

SEQ ID NO: 2008 - RNA, 19 nt, Artificial Sequence
  Description of Artificial Sequence:  synthetic
uuguuucucguuuuaauuu

SEQ ID NO: 2009 - RNA, 19 nt, Artificial Sequence
  Description of Artificial Sequence:  synthetic
uauuuuugcuugccauucc

SEQ ID NO: 2010 - RNA, 19 nt, Artificial Sequence
  Description of Artificial Sequence:  synthetic
cccacuugaaucgggccga

SEQ ID NO: 2011 - RNA, 19 nt, Artificial Sequence
  Description of Artificial Sequence:  synthetic
acggcuuggggagauugcu

SEQ ID NO: 2012 - RNA, 19 nt, Artificial Sequence
  Description of Artificial Sequence:  synthetic
ucuacuuccccaaaucacu

SEQ ID NO: 2013 - RNA, 19 nt, Artificial Sequence
  Description of Artificial Sequence:  synthetic
uguggauuuuggaaaccag

SEQ ID NO: 2014 - RNA, 19 nt, Artificial Sequence
  Description of Artificial Sequence:  synthetic
gcagaaagaggaaagaggu

SEQ ID NO: 2015 - RNA, 19 nt, Artificial Sequence
  Description of Artificial Sequence:  synthetic
uagcaagagcuccagagag

SEQ ID NO: 2016 - RNA, 19 nt, Artificial Sequence
  Description of Artificial Sequence:  synthetic
gaagucgaggaagagagag

SEQ ID NO: 2017 - RNA, 19 nt, Artificial Sequence
  Description of Artificial Sequence:  synthetic
gacggggucagagagagcg

SEQ ID NO: 2018 - RNA, 19 nt, Artificial Sequence
  Description of Artificial Sequence:  synthetic
gcgcgggcgugcgagcagc

SEQ ID NO: 2019 - RNA, 19 nt, Artificial Sequence
  Description of Artificial Sequence:  synthetic
cgaaagcgacaggggcaaa

SEQ ID NO: 2020 - RNA, 19 nt, Artificial Sequence
  Description of Artificial Sequence:  synthetic
agugagugaccugcuuuug

SEQ ID NO: 2021 - RNA, 19 nt, Artificial Sequence
  Description of Artificial Sequence:  synthetic
gggggugaccgccggagcg

SEQ ID NO: 2022 - RNA, 19 nt, Artificial Sequence
  Description of Artificial Sequence:  synthetic
gcggcgugagcccuccccc

SEQ ID NO: 2023 - RNA, 19 nt, Artificial Sequence
  Description of Artificial Sequence:  synthetic
cuugggaucccgcagcuga

SEQ ID NO: 2024 - RNA, 19 nt, Artificial Sequence
  Description of Artificial Sequence:  synthetic
accagucgcgcugacggac

SEQ ID NO: 2025 - RNA, 19 nt, Artificial Sequence
  Description of Artificial Sequence:  synthetic
cagacagacagacaccgcc

SEQ ID NO: 2026 - RNA, 19 nt, Artificial Sequence
  Description of Artificial Sequence:  synthetic
ccccagccccagcuaccac

SEQ ID NO: 2027 - RNA, 19 nt, Artificial Sequence
  Description of Artificial Sequence:  synthetic
ccuccuccccggccggcgg

SEQ ID NO: 2028 - RNA, 19 nt, Artificial Sequence
  Description of Artificial Sequence:  synthetic
gcggacaguggacgcggcg

SEQ ID NO: 2029 - RNA, 19 nt, Artificial Sequence
  Description of Artificial Sequence:  synthetic
ggcgagccgcgggcagggg

SEQ ID NO: 2030 - RNA, 19 nt, Artificial Sequence
  Description of Artificial Sequence:  synthetic
gccggagcccgcgcccgga

SEQ ID NO: 2031 - RNA, 19 nt, Artificial Sequence
  Description of Artificial Sequence:  synthetic
aggcgggguggaggggguc

SEQ ID NO: 2032 - RNA, 19 nt, Artificial Sequence
  Description of Artificial Sequence:  synthetic
cggggcucgcggcgucgca

SEQ ID NO: 2033 - RNA, 19 nt, Artificial Sequence
  Description of Artificial Sequence:  synthetic
acugaaacuuuucguccaa

SEQ ID NO: 2034 - RNA, 19 nt, Artificial Sequence
  Description of Artificial Sequence:  synthetic
acuucugggcuguucucgc

SEQ ID NO: 2035 - RNA, 19 nt, Artificial Sequence
  Description of Artificial Sequence:  synthetic
cuucggaggagccgugguc

SEQ ID NO: 2036 - RNA, 19 nt, Artificial Sequence
  Description of Artificial Sequence:  synthetic
ccgcgcgggggaagccgag

SEQ ID NO: 2037 - RNA, 19 nt, Artificial Sequence
  Description of Artificial Sequence:  synthetic
gccgagcggagccgcgaga

SEQ ID NO: 2038 - RNA, 19 nt, Artificial Sequence
  Description of Artificial Sequence:  synthetic
aagugcuagcucgggccgg

SEQ ID NO: 2039 - RNA, 19 nt, Artificial Sequence
  Description of Artificial Sequence:  synthetic
ggaggagccgcagccggag

SEQ ID NO: 2040 - RNA, 19 nt, Artificial Sequence
  Description of Artificial Sequence:  synthetic
ggagggggaggaggaagaa

SEQ ID NO: 2041 - RNA, 19 nt, Artificial Sequence
  Description of Artificial Sequence:  synthetic
agagaaggaagaggagagg

SEQ ID NO: 2042 - RNA, 19 nt, Artificial Sequence
  Description of Artificial Sequence:  synthetic
ggggccgcaguggcgacuc

SEQ ID NO: 2043 - RNA, 19 nt, Artificial Sequence
  Description of Artificial Sequence:  synthetic
cggcgcucggaagccgggc

SEQ ID NO: 2044 - RNA, 19 nt, Artificial Sequence
  Description of Artificial Sequence:  synthetic
cucauggacgggugaggcg

SEQ ID NO: 2045 - RNA, 19 nt, Artificial Sequence
  Description of Artificial Sequence:  synthetic
ggcggugugcgcagacagu

SEQ ID NO: 2046 - RNA, 19 nt, Artificial Sequence
  Description of Artificial Sequence:  synthetic
ugcuccagccgcgcgcgcu

SEQ ID NO: 2047 - RNA, 19 nt, Artificial Sequence
  Description of Artificial Sequence:  synthetic
uccccaggcccuggcccgg

SEQ ID NO: 2048 - RNA, 19 nt, Artificial Sequence
  Description of Artificial Sequence:  synthetic
ggccucgggccggggagga

SEQ ID NO: 2049 - RNA, 19 nt, Artificial Sequence
  Description of Artificial Sequence:  synthetic
aagaguagcucgccgaggc

SEQ ID NO: 2050 - RNA, 19 nt, Artificial Sequence
  Description of Artificial Sequence:  synthetic
cgccgaggagagcgggccg

SEQ ID NO: 2051 - RNA, 19 nt, Artificial Sequence
  Description of Artificial Sequence:  synthetic
gccccacagcccgagccgg

SEQ ID NO: 2052 - RNA, 19 nt, Artificial Sequence
  Description of Artificial Sequence:  synthetic
gagagggagcgcgagccgc

SEQ ID NO: 2053 - RNA, 19 nt, Artificial Sequence
  Description of Artificial Sequence:  synthetic
cgccggccccggucgggcc

SEQ ID NO: 2054 - RNA, 19 nt, Artificial Sequence
  Description of Artificial Sequence:  synthetic
cuccgaaaccaugaacuuu

SEQ ID NO: 2055 - RNA, 19 nt, Artificial Sequence
  Description of Artificial Sequence:  synthetic
ucugcugucuugggugcau

SEQ ID NO: 2056 - RNA, 19 nt, Artificial Sequence
  Description of Artificial Sequence:  synthetic
uuggagccuugccuugcug

SEQ ID NO: 2057 - RNA, 19 nt, Artificial Sequence
  Description of Artificial Sequence:  synthetic
gcucuaccuccaccaugcc

SEQ ID NO: 2058 - RNA, 19 nt, Artificial Sequence
  Description of Artificial Sequence:  synthetic
caaguggucccaggcugca

SEQ ID NO: 2059 - RNA, 19 nt, Artificial Sequence
  Description of Artificial Sequence:  synthetic
acccauggcagaaggagga

SEQ ID NO: 2060 - RNA, 19 nt, Artificial Sequence
  Description of Artificial Sequence:  synthetic
agggcagaaucaucacgaa

SEQ ID NO: 2061 - RNA, 19 nt, Artificial Sequence
  Description of Artificial Sequence:  synthetic
aguggugaaguucauggau

SEQ ID NO: 2062 - RNA, 19 nt, Artificial Sequence
  Description of Artificial Sequence:  synthetic
ugucuaucagcgcagcuac

SEQ ID NO: 2063 - RNA, 19 nt, Artificial Sequence
  Description of Artificial Sequence:  synthetic
cugccauccaaucgagacc

SEQ ID NO: 2064 - RNA, 19 nt, Artificial Sequence
  Description of Artificial Sequence:  synthetic
ccugguggacaucuuccag

SEQ ID NO: 2065 - RNA, 19 nt, Artificial Sequence
  Description of Artificial Sequence:  synthetic
ggaguacccugaugagauc

SEQ ID NO: 2066 - RNA, 19 nt, Artificial Sequence
  Description of Artificial Sequence:  synthetic
cgaguacaucuucaagcca

SEQ ID NO: 2067 - RNA, 19 nt, Artificial Sequence
  Description of Artificial Sequence:  synthetic
auccugugugccccugaug

SEQ ID NO: 2068 - RNA, 19 nt, Artificial Sequence
  Description of Artificial Sequence:  synthetic
gcgaugcgggggcugcugc

SEQ ID NO: 2069 - RNA, 19 nt, Artificial Sequence
  Description of Artificial Sequence:  synthetic
caaugacgagggccuggag

SEQ ID NO: 2070 - RNA, 19 nt, Artificial Sequence
  Description of Artificial Sequence:  synthetic
gugugugcccacugaggag

SEQ ID NO: 2071 - RNA, 19 nt, Artificial Sequence
  Description of Artificial Sequence:  synthetic
guccaacaucaccaugcag

SEQ ID NO: 2072 - RNA, 19 nt, Artificial Sequence
  Description of Artificial Sequence:  synthetic
gauuaugcggaucaaaccu

SEQ ID NO: 2073 - RNA, 19 nt, Artificial Sequence
  Description of Artificial Sequence:  synthetic
ucaccaaggccagcacaua

SEQ ID NO: 2074 - RNA, 19 nt, Artificial Sequence
  Description of Artificial Sequence:  synthetic
aggagagaugagcuuccua

SEQ ID NO: 2075 - RNA, 19 nt, Artificial Sequence
  Description of Artificial Sequence:  synthetic
acagcacaacaaaugugaa

SEQ ID NO: 2076 - RNA, 19 nt, Artificial Sequence
  Description of Artificial Sequence:  synthetic
augcagaccaaagaaagau

SEQ ID NO: 2077 - RNA, 19 nt, Artificial Sequence
  Description of Artificial Sequence:  synthetic
uagagcaagacaagaaaaa

SEQ ID NO: 2078 - RNA, 19 nt, Artificial Sequence
  Description of Artificial Sequence:  synthetic
aaaaucaguucgaggaaag

SEQ ID NO: 2079 - RNA, 19 nt, Artificial Sequence
  Description of Artificial Sequence:  synthetic
gggaaaggggcaaaaacga

SEQ ID NO: 2080 - RNA, 19 nt, Artificial Sequence
  Description of Artificial Sequence:  synthetic
aaagcgcaagaaaucccgg

SEQ ID NO: 2081 - RNA, 19 nt, Artificial Sequence
  Description of Artificial Sequence:  synthetic
guauaaguccuggagcguu

SEQ ID NO: 2082 - RNA, 19 nt, Artificial Sequence
  Description of Artificial Sequence:  synthetic
ucccugugggccuugcuca

SEQ ID NO: 2083 - RNA, 19 nt, Artificial Sequence
  Description of Artificial Sequence:  synthetic
agagcggagaaagcauuug

SEQ ID NO: 2084 - RNA, 19 nt, Artificial Sequence
  Description of Artificial Sequence:  synthetic
guuuguacaagauccgcag

SEQ ID NO: 2085 - RNA, 19 nt, Artificial Sequence
  Description of Artificial Sequence:  synthetic
gacguguaaauguuccugc

SEQ ID NO: 2086 - RNA, 19 nt, Artificial Sequence
  Description of Artificial Sequence:  synthetic
caaaaacacagacucgcgu

SEQ ID NO: 2087 - RNA, 19 nt, Artificial Sequence
  Description of Artificial Sequence:  synthetic
uugcaaggcgaggcagcuu

SEQ ID NO: 2088 - RNA, 19 nt, Artificial Sequence
  Description of Artificial Sequence:  synthetic
ugaguuaaacgaacguacu

SEQ ID NO: 2089 - RNA, 19 nt, Artificial Sequence
  Description of Artificial Sequence:  synthetic
uugcagaugugacaagccg

SEQ ID NO: 2090 - RNA, 19 nt, Artificial Sequence
  Description of Artificial Sequence:  synthetic
gaggcggugagccgggcag

SEQ ID NO: 2091 - RNA, 19 nt, Artificial Sequence
  Description of Artificial Sequence:  synthetic
ggaggaaggagccucccuc

SEQ ID NO: 2092 - RNA, 19 nt, Artificial Sequence
  Description of Artificial Sequence:  synthetic
gagccucccucaggguuuc

SEQ ID NO: 2093 - RNA, 19 nt, Artificial Sequence
  Description of Artificial Sequence:  synthetic
ggcugccccaagccuccgc

SEQ ID NO: 2094 - RNA, 19 nt, Artificial Sequence
  Description of Artificial Sequence:  synthetic
acgaccuccgagcuacccg

SEQ ID NO: 2095 - RNA, 19 nt, Artificial Sequence
  Description of Artificial Sequence:  synthetic
gugcuagcccccagcgcca

SEQ ID NO: 2096 - RNA, 19 nt, Artificial Sequence
  Description of Artificial Sequence:  synthetic
ccucccgacagagcgcugg

SEQ ID NO: 2097 - RNA, 19 nt, Artificial Sequence
  Description of Artificial Sequence:  synthetic
guccaccuaaccgcugcgc

SEQ ID NO: 2098 - RNA, 19 nt, Artificial Sequence
  Description of Artificial Sequence:  synthetic
cggugaguccgcugaccgg

SEQ ID NO: 2099 - RNA, 19 nt, Artificial Sequence
  Description of Artificial Sequence:  synthetic
agcaccgagcgcccuggcc

SEQ ID NO: 2100 - RNA, 19 nt, Artificial Sequence
  Description of Artificial Sequence:  synthetic
caaugaauaucaaauucca

SEQ ID NO: 2101 - RNA, 19 nt, Artificial Sequence
  Description of Artificial Sequence:  synthetic
gagggauaaaacccggauc

SEQ ID NO: 2102 - RNA, 19 nt, Artificial Sequence
  Description of Artificial Sequence:  synthetic
auguuuaagaaaaaagaag

SEQ ID NO: 2103 - RNA, 19 nt, Artificial Sequence
  Description of Artificial Sequence:  synthetic
auacaguuuuaaaaaaaaa

SEQ ID NO: 2104 - RNA, 19 nt, Artificial Sequence
  Description of Artificial Sequence:  synthetic
aaauuaaaacgagaaacaa

SEQ ID NO: 2105 - RNA, 19 nt, Artificial Sequence
  Description of Artificial Sequence:  synthetic
ggaauggcaagcaaaaaua

SEQ ID NO: 2106 - RNA, 19 nt, Artificial Sequence
  Description of Artificial Sequence:  synthetic
ucggcccgauucaaguggg

SEQ ID NO: 2107 - RNA, 19 nt, Artificial Sequence
  Description of Artificial Sequence:  synthetic
agcaaucuccccaagccgu

SEQ ID NO: 2108 - RNA, 19 nt, Artificial Sequence
  Description of Artificial Sequence:  synthetic
agugauuuggggaaguaga

SEQ ID NO: 2109 - RNA, 19 nt, Artificial Sequence
  Description of Artificial Sequence:  synthetic
cugguuuccaaaauccaca

SEQ ID NO: 2110 - RNA, 19 nt, Artificial Sequence
  Description of Artificial Sequence:  synthetic
accucuuuccucuuucugc

SEQ ID NO: 2111 - RNA, 19 nt, Artificial Sequence
  Description of Artificial Sequence:  synthetic
cucucuggagcucuugcua

SEQ ID NO: 2112 - RNA, 19 nt, Artificial Sequence
  Description of Artificial Sequence:  synthetic
cucucucuuccucgacuuc

SEQ ID NO: 2113 - RNA, 19 nt, Artificial Sequence
  Description of Artificial Sequence:  synthetic
cgcucucucugaccccguc

SEQ ID NO: 2114 - RNA, 19 nt, Artificial Sequence
  Description of Artificial Sequence:  synthetic
gcugcucgcacgcccgcgc

SEQ ID NO: 2115 - RNA, 19 nt, Artificial Sequence
  Description of Artificial Sequence:  synthetic
uuugccccugucgcuuucg

SEQ ID NO: 2116 - RNA, 19 nt, Artificial Sequence
  Description of Artificial Sequence:  synthetic
caaaagcaggucacucacu

SEQ ID NO: 2117 - RNA, 19 nt, Artificial Sequence
  Description of Artificial Sequence:  synthetic
cgcuccggcggucaccccc

SEQ ID NO: 2118 - RNA, 19 nt, Artificial Sequence
  Description of Artificial Sequence:  synthetic
gggggagggcucacgccgc

SEQ ID NO: 2119 - RNA, 19 nt, Artificial Sequence
  Description of Artificial Sequence:  synthetic
ucagcugcgggaucccaag

SEQ ID NO: 2120 - RNA, 19 nt, Artificial Sequence
  Description of Artificial Sequence:  synthetic
guccgucagcgcgacuggu

SEQ ID NO: 2121 - RNA, 19 nt, Artificial Sequence
  Description of Artificial Sequence:  synthetic
ggcggugucugucugucug

SEQ ID NO: 2122 - RNA, 19 nt, Artificial Sequence
  Description of Artificial Sequence:  synthetic
gugguagcuggggcugggg

SEQ ID NO: 2123 - RNA, 19 nt, Artificial Sequence
  Description of Artificial Sequence:  synthetic
ccgccggccggggaggagg

SEQ ID NO: 2124 - RNA, 19 nt, Artificial Sequence
  Description of Artificial Sequence:  synthetic
cgccgcguccacuguccgc

SEQ ID NO: 2125 - RNA, 19 nt, Artificial Sequence
  Description of Artificial Sequence:  synthetic
ccccugcccgcggcucgcc

SEQ ID NO: 2126 - RNA, 19 nt, Artificial Sequence
  Description of Artificial Sequence:  synthetic
uccgggcgcgggcuccggc

SEQ ID NO: 2127 - RNA, 19 nt, Artificial Sequence
  Description of Artificial Sequence:  synthetic
gacccccuccaccccgccu

SEQ ID NO: 2128 - RNA, 19 nt, Artificial Sequence
  Description of Artificial Sequence:  synthetic
ugcgacgccgcgagccccg

SEQ ID NO: 2129 - RNA, 19 nt, Artificial Sequence
  Description of Artificial Sequence:  synthetic
uuggacgaaaaguuucagu

SEQ ID NO: 2130 - RNA, 19 nt, Artificial Sequence
  Description of Artificial Sequence:  synthetic
gcgagaacagcccagaagu

SEQ ID NO: 2131 - RNA, 19 nt, Artificial Sequence
  Description of Artificial Sequence:  synthetic
gaccacggcuccuccgaag

SEQ ID NO: 2132 - RNA, 19 nt, Artificial Sequence
  Description of Artificial Sequence:  synthetic
cucggcuucccccgcgcgg

SEQ ID NO: 2133 - RNA, 19 nt, Artificial Sequence
  Description of Artificial Sequence:  synthetic
ucucgcggcuccgcucggc

SEQ ID NO: 2134 - RNA, 19 nt, Artificial Sequence
  Description of Artificial Sequence:  synthetic
ccggcccgagcuagcacuu

SEQ ID NO: 2135 - RNA, 19 nt, Artificial Sequence
  Description of Artificial Sequence:  synthetic
cuccggcugcggcuccucc

SEQ ID NO: 2136 - RNA, 19 nt, Artificial Sequence
  Description of Artificial Sequence:  synthetic
uucuuccuccucccccucc

SEQ ID NO: 2137 - RNA, 19 nt, Artificial Sequence
  Description of Artificial Sequence:  synthetic
ccucuccucuuccuucucu

SEQ ID NO: 2138 - RNA, 19 nt, Artificial Sequence
  Description of Artificial Sequence:  synthetic
gagucgccacugcggcccc

SEQ ID NO: 2139 - RNA, 19 nt, Artificial Sequence
  Description of Artificial Sequence:  synthetic
gcccggcuuccgagcgccg

SEQ ID NO: 2140 - RNA, 19 nt, Artificial Sequence
  Description of Artificial Sequence:  synthetic
cgccucacccguccaugag

SEQ ID NO: 2141 - RNA, 19 nt, Artificial Sequence
  Description of Artificial Sequence:  synthetic
acugucugcgcacaccgcc

SEQ ID NO: 2142 - RNA, 19 nt, Artificial Sequence
  Description of Artificial Sequence:  synthetic
agcgcgcgcggcuggagca

SEQ ID NO: 2143 - RNA, 19 nt, Artificial Sequence
  Description of Artificial Sequence:  synthetic
ccgggccagggccugggga

SEQ ID NO: 2144 - RNA, 19 nt, Artificial Sequence
  Description of Artificial Sequence:  synthetic
uccuccccggcccgaggcc

SEQ ID NO: 2145 - RNA, 19 nt, Artificial Sequence
  Description of Artificial Sequence:  synthetic
gccucggcgagcuacucuu

SEQ ID NO: 2146 - RNA, 19 nt, Artificial Sequence
  Description of Artificial Sequence:  synthetic
cggcccgcucuccucggcg

SEQ ID NO: 2147 - RNA, 19 nt, Artificial Sequence
  Description of Artificial Sequence:  synthetic
ccggcucgggcuguggggc

SEQ ID NO: 2148 - RNA, 19 nt, Artificial Sequence
  Description of Artificial Sequence:  synthetic
gcggcucgcgcucccucuc

SEQ ID NO: 2149 - RNA, 19 nt, Artificial Sequence
  Description of Artificial Sequence:  synthetic
ggcccgaccggggccggcg

SEQ ID NO: 2150 - RNA, 19 nt, Artificial Sequence
  Description of Artificial Sequence:  synthetic
aaaguucaugguuucggag

SEQ ID NO: 2151 - RNA, 19 nt, Artificial Sequence
  Description of Artificial Sequence:  synthetic
augcacccaagacagcaga

SEQ ID NO: 2152 - RNA, 19 nt, Artificial Sequence
  Description of Artificial Sequence:  synthetic
cagcaaggcaaggcuccaa

SEQ ID NO: 2153 - RNA, 19 nt, Artificial Sequence
  Description of Artificial Sequence:  synthetic
ggcaugguggagguagagc

SEQ ID NO: 2154 - RNA, 19 nt, Artificial Sequence
  Description of Artificial Sequence:  synthetic
ugcagccugggaccacuug

SEQ ID NO: 2155 - RNA, 19 nt, Artificial Sequence
  Description of Artificial Sequence:  synthetic
uccuccuucugccaugggu

SEQ ID NO: 2156 - RNA, 19 nt, Artificial Sequence
  Description of Artificial Sequence:  synthetic
uucgugaugauucugcccu

SEQ ID NO: 2157 - RNA, 19 nt, Artificial Sequence
  Description of Artificial Sequence:  synthetic
auccaugaacuucaccacu

SEQ ID NO: 2158 - RNA, 19 nt, Artificial Sequence
  Description of Artificial Sequence:  synthetic
guagcugcgcugauagaca

SEQ ID NO: 2159 - RNA, 19 nt, Artificial Sequence
  Description of Artificial Sequence:  synthetic
ggucucgauuggauggcag

SEQ ID NO: 2160 - RNA, 19 nt, Artificial Sequence
  Description of Artificial Sequence:  synthetic
cuggaagauguccaccagg

SEQ ID NO: 2161 - RNA, 19 nt, Artificial Sequence
  Description of Artificial Sequence:  synthetic
gaucucaucaggguacucc

SEQ ID NO: 2162 - RNA, 19 nt, Artificial Sequence
  Description of Artificial Sequence:  synthetic
uggcuugaagauguacucg

SEQ ID NO: 2163 - RNA, 19 nt, Artificial Sequence
  Description of Artificial Sequence:  synthetic
caucaggggcacacaggau

SEQ ID NO: 2164 - RNA, 19 nt, Artificial Sequence
  Description of Artificial Sequence:  synthetic
gcagcagcccccgcaucgc

SEQ ID NO: 2165 - RNA, 19 nt, Artificial Sequence
  Description of Artificial Sequence:  synthetic
cuccaggcccucgucauug

SEQ ID NO: 2166 - RNA, 19 nt, Artificial Sequence
  Description of Artificial Sequence:  synthetic
cuccucagugggcacacac

SEQ ID NO: 2167 - RNA, 19 nt, Artificial Sequence
  Description of Artificial Sequence:  synthetic
cugcauggugauguuggac

SEQ ID NO: 2168 - RNA, 19 nt, Artificial Sequence
  Description of Artificial Sequence:  synthetic
agguuugauccgcauaauc

SEQ ID NO: 2169 - RNA, 19 nt, Artificial Sequence
  Description of Artificial Sequence:  synthetic
uaugugcuggccuugguga

SEQ ID NO: 2170 - RNA, 19 nt, Artificial Sequence
  Description of Artificial Sequence:  synthetic
uaggaagcucaucucuccu

SEQ ID NO: 2171 - RNA, 19 nt, Artificial Sequence
  Description of Artificial Sequence:  synthetic
uucacauuuguugugcugu

SEQ ID NO: 2172 - RNA, 19 nt, Artificial Sequence
  Description of Artificial Sequence:  synthetic
aucuuucuuuggucugcau

SEQ ID NO: 2173 - RNA, 19 nt, Artificial Sequence
  Description of Artificial Sequence:  synthetic
uuuuucuugucuugcucua

SEQ ID NO: 2174 - RNA, 19 nt, Artificial Sequence
  Description of Artificial Sequence:  synthetic
cuuuccucgaacugauuuu

SEQ ID NO: 2175 - RNA, 19 nt, Artificial Sequence
  Description of Artificial Sequence:  synthetic
ucguuuuugccccuuuccc

SEQ ID NO: 2176 - RNA, 19 nt, Artificial Sequence
  Description of Artificial Sequence:  synthetic
ccgggauuucuugcgcuuu

SEQ ID NO: 2177 - RNA, 19 nt, Artificial Sequence
  Description of Artificial Sequence:  synthetic
aacgcuccaggacuuauac

SEQ ID NO: 2178 - RNA, 19 nt, Artificial Sequence
  Description of Artificial Sequence:  synthetic
ugagcaaggcccacaggga

SEQ ID NO: 2179 - RNA, 19 nt, Artificial Sequence
  Description of Artificial Sequence:  synthetic
caaaugcuuucuccgcucu

SEQ ID NO: 2180 - RNA, 19 nt, Artificial Sequence
  Description of Artificial Sequence:  synthetic
cugcggaucuuguacaaac

SEQ ID NO: 2181 - RNA, 19 nt, Artificial Sequence
  Description of Artificial Sequence:  synthetic
gcaggaacauuuacacguc

SEQ ID NO: 2182 - RNA, 19 nt, Artificial Sequence
  Description of Artificial Sequence:  synthetic
acgcgagucuguguuuuug

SEQ ID NO: 2183 - RNA, 19 nt, Artificial Sequence
  Description of Artificial Sequence:  synthetic
aagcugccucgccuugcaa

SEQ ID NO: 2184 - RNA, 19 nt, Artificial Sequence
  Description of Artificial Sequence:  synthetic
aguacguucguuuaacuca

SEQ ID NO: 2185 - RNA, 19 nt, Artificial Sequence
  Description of Artificial Sequence:  synthetic
cggcuugucacaucugcaa

SEQ ID NO: 2186 - RNA, 19 nt, Artificial Sequence
  Description of Artificial Sequence:  synthetic
cugcccggcucaccgccuc

SEQ ID NO: 2187 - RNA, 19 nt, Artificial Sequence
  Description of Artificial Sequence:  synthetic
gagggaggcuccuuccucc

SEQ ID NO: 2188 - RNA, 19 nt, Artificial Sequence
  Description of Artificial Sequence:  synthetic
gaaacccugagggaggcuc

SEQ ID NO: 2189 - RNA, 23 nt, Artificial Sequence
  Description of Artificial Sequence:  synthetic
aucaugcuggacugcuggcacag

SEQ ID NO: 2190 - RNA, 23 nt, Artificial Sequence
  Description of Artificial Sequence:  synthetic
accaugcuggacugcuggcacgg

SEQ ID NO: 2191 - RNA, 23 nt, Artificial Sequence
  Description of Artificial Sequence:  synthetic
aucauguuggauugcuggcacaa

SEQ ID NO: 2192 - RNA, 23 nt, Artificial Sequence
  Description of Artificial Sequence:  synthetic
accaugcuggacugcuggcauga

SEQ ID NO: 2193 - RNA, 23 nt, Artificial Sequence
  Description of Artificial Sequence:  synthetic
aucaugcuggauugcuggcacaa

SEQ ID NO: 2194 - RNA, 23 nt, Artificial Sequence
  Description of Artificial Sequence:  synthetic
accaugcuggauugcuggcauga

SEQ ID NO: 2195 - RNA, 23 nt, Artificial Sequence
  Description of Artificial Sequence:  synthetic
ucaugcuggacugcuggcacaga

SEQ ID NO: 2196 - RNA, 23 nt, Artificial Sequence
  Description of Artificial Sequence:  synthetic
ccaugcuggacugcuggcacggg

SEQ ID NO: 2197 - RNA, 23 nt, Artificial Sequence
  Description of Artificial Sequence:  synthetic
ucauguuggauugcuggcacaaa

SEQ ID NO: 2198 - RNA, 23 nt, Artificial Sequence
  Description of Artificial Sequence:  synthetic
ccaugcuggacugcuggcaugag

SEQ ID NO: 2199 - RNA, 23 nt, Artificial Sequence
  Description of Artificial Sequence:  synthetic
ucaugcuggauugcuggcacaaa

SEQ ID NO: 2200 - RNA, 23 nt, Artificial Sequence
  Description of Artificial Sequence:  synthetic
ccaugcuggauugcuggcaugag

SEQ ID NO: 2201 - RNA, 23 nt, Artificial Sequence
  Description of Artificial Sequence:  synthetic
caugcuggacugcuggcacagag

SEQ ID NO: 2202 - RNA, 23 nt, Artificial Sequence
  Description of Artificial Sequence:  synthetic
caugcuggacugcuggcacgggg

SEQ ID NO: 2203 - RNA, 23 nt, Artificial Sequence
  Description of Artificial Sequence:  synthetic
cauguuggauugcuggcacaaag

SEQ ID NO: 2204 - RNA, 23 nt, Artificial Sequence
  Description of Artificial Sequence:  synthetic
caugcuggacugcuggcaugagg

SEQ ID NO: 2205 - RNA, 23 nt, Artificial Sequence
  Description of Artificial Sequence:  synthetic
caugcuggauugcuggcacaaag

SEQ ID NO: 2206 - RNA, 23 nt, Artificial Sequence
  Description of Artificial Sequence:  synthetic
caugcuggauugcuggcaugagg

SEQ ID NO: 2207 - RNA, 23 nt, Artificial Sequence
  Description of Artificial Sequence:  synthetic
ugccuuaugaugccagcaaaugg

SEQ ID NO: 2208 - RNA, 23 nt, Artificial Sequence
  Description of Artificial Sequence:  synthetic
ucccuuaugaugccagcaagugg

SEQ ID NO: 2209 - RNA, 23 nt, Artificial Sequence
  Description of Artificial Sequence:  synthetic
ugcccuaugaugccagcaagugg

SEQ ID NO: 2210 - RNA, 23 nt, Artificial Sequence
  Description of Artificial Sequence:  synthetic
ugccuuaugaugccagcaagugg

SEQ ID NO: 2211 - RNA, 23 nt, Artificial Sequence
  Description of Artificial Sequence:  synthetic
gccuuaugaugccagcaaauggg

SEQ ID NO: 2212 - RNA, 23 nt, Artificial Sequence
  Description of Artificial Sequence:  synthetic
cccuuaugaugccagcaaguggg

SEQ ID NO: 2213 - RNA, 23 nt, Artificial Sequence
  Description of Artificial Sequence:  synthetic
gcccuaugaugccagcaaguggg

SEQ ID NO: 2214 - RNA, 23 nt, Artificial Sequence
  Description of Artificial Sequence:  synthetic
gccuuaugaugccagcaaguggg

SEQ ID NO: 2215 - RNA, 23 nt, Artificial Sequence
  Description of Artificial Sequence:  synthetic
ccuuaugaugccagcaaauggga

SEQ ID NO: 2216 - RNA, 23 nt, Artificial Sequence
  Description of Artificial Sequence:  synthetic
ccuuaugaugccagcaaguggga

SEQ ID NO: 2217 - RNA, 23 nt, Artificial Sequence
  Description of Artificial Sequence:  synthetic
cccuaugaugccagcaaguggga

SEQ ID NO: 2218 - RNA, 23 nt, Artificial Sequence
  Description of Artificial Sequence:  synthetic
cuuaugaugccagcaaaugggaa

SEQ ID NO: 2219 - RNA, 23 nt, Artificial Sequence
  Description of Artificial Sequence:  synthetic
cuuaugaugccagcaagugggag

SEQ ID NO: 2220 - RNA, 23 nt, Artificial Sequence
  Description of Artificial Sequence:  synthetic
ccuaugaugccagcaagugggag

SEQ ID NO: 2221 - RNA, 23 nt, Artificial Sequence
  Description of Artificial Sequence:  synthetic
cuuaugaugccagcaagugggaa

SEQ ID NO: 2222 - RNA, 23 nt, Artificial Sequence
  Description of Artificial Sequence:  synthetic
uuaugaugccagcaaaugggaau

SEQ ID NO: 2223 - RNA, 23 nt, Artificial Sequence
  Description of Artificial Sequence:  synthetic
uuaugaugccagcaagugggagu

SEQ ID NO: 2224 - RNA, 23 nt, Artificial Sequence
  Description of Artificial Sequence:  synthetic
cuaugaugccagcaagugggagu

SEQ ID NO: 2225 - RNA, 23 nt, Artificial Sequence
  Description of Artificial Sequence:  synthetic
uuaugaugccagcaagugggaau

SEQ ID NO: 2226 - RNA, 23 nt, Artificial Sequence
  Description of Artificial Sequence:  synthetic
accagaccaugcuggacugcugg

SEQ ID NO: 2227 - RNA, 23 nt, Artificial Sequence
  Description of Artificial Sequence:  synthetic
aucagaucaugcuggacugcugg

SEQ ID NO: 2228 - RNA, 23 nt, Artificial Sequence
  Description of Artificial Sequence:  synthetic
accaaaucauguuggauugcugg

SEQ ID NO: 2229 - RNA, 23 nt, Artificial Sequence
  Description of Artificial Sequence:  synthetic
accaaaucaugcuggauugcugg

SEQ ID NO: 2230 - RNA, 23 nt, Artificial Sequence
  Description of Artificial Sequence:  synthetic
accaaaccaugcuggauugcugg

SEQ ID NO: 2231 - RNA, 23 nt, Artificial Sequence
  Description of Artificial Sequence:  synthetic
ccagaccaugcuggacugcuggc

SEQ ID NO: 2232 - RNA, 23 nt, Artificial Sequence
  Description of Artificial Sequence:  synthetic
ucagaucaugcuggacugcuggc

SEQ ID NO: 2233 - RNA, 23 nt, Artificial Sequence
  Description of Artificial Sequence:  synthetic
ccaaaucauguuggauugcuggc

SEQ ID NO: 2234 - RNA, 23 nt, Artificial Sequence
  Description of Artificial Sequence:  synthetic
ccaaaucaugcuggauugcuggc

SEQ ID NO: 2235 - RNA, 23 nt, Artificial Sequence
  Description of Artificial Sequence:  synthetic
ccaaaccaugcuggauugcuggc

SEQ ID NO: 2236 - RNA, 23 nt, Artificial Sequence
  Description of Artificial Sequence:  synthetic
cagaccaugcuggacugcuggca

SEQ ID NO: 2237 - RNA, 23 nt, Artificial Sequence
  Description of Artificial Sequence:  synthetic
cagaucaugcuggacugcuggca

SEQ ID NO: 2238 - RNA, 23 nt, Artificial Sequence
  Description of Artificial Sequence:  synthetic
caaaucauguuggauugcuggca

SEQ ID NO: 2239 - RNA, 23 nt, Artificial Sequence
  Description of Artificial Sequence:  synthetic
caaaucaugcuggauugcuggca

SEQ ID NO: 2240 - RNA, 23 nt, Artificial Sequence
  Description of Artificial Sequence:  synthetic
caaaccaugcuggauugcuggca

SEQ ID NO: 2241 - RNA, 23 nt, Artificial Sequence
  Description of Artificial Sequence:  synthetic
agaccaugcuggacugcuggcac

SEQ ID NO: 2242 - RNA, 23 nt, Artificial Sequence
  Description of Artificial Sequence:  synthetic
agaucaugcuggacugcuggcac

SEQ ID NO: 2243 - RNA, 23 nt, Artificial Sequence
  Description of Artificial Sequence:  synthetic
aaaucauguuggauugcuggcac

SEQ ID NO: 2244 - RNA, 23 nt, Artificial Sequence
  Description of Artificial Sequence:  synthetic
agaccaugcuggacugcuggcau

SEQ ID NO: 2245 - RNA, 23 nt, Artificial Sequence
  Description of Artificial Sequence:  synthetic
aaaucaugcuggauugcuggcac

SEQ ID NO: 2246 - RNA, 23 nt, Artificial Sequence
  Description of Artificial Sequence:  synthetic
aaaccaugcuggauugcuggcau

SEQ ID NO: 2247 - RNA, 23 nt, Artificial Sequence
  Description of Artificial Sequence:  synthetic
gaccaugcuggacugcuggcacg

SEQ ID NO: 2248 - RNA, 23 nt, Artificial Sequence
  Description of Artificial Sequence:  synthetic
gaucaugcuggacugcuggcaca

SEQ ID NO: 2249 - RNA, 23 nt, Artificial Sequence
  Description of Artificial Sequence:  synthetic
aaucauguuggauugcuggcaca

SEQ ID NO: 2250 - RNA, 23 nt, Artificial Sequence
  Description of Artificial Sequence:  synthetic
gaccaugcuggacugcuggcaug

SEQ ID NO: 2251 - RNA, 23 nt, Artificial Sequence
  Description of Artificial Sequence:  synthetic
aaucaugcuggauugcuggcaca

SEQ ID NO: 2252 - RNA, 23 nt, Artificial Sequence
  Description of Artificial Sequence:  synthetic
aaccaugcuggauugcuggcaug

SEQ ID NO: 2253 - RNA, 23 nt, Artificial Sequence
  Description of Artificial Sequence:  synthetic
agcaggauggcaaagacuacauu

SEQ ID NO: 2254 - RNA, 23 nt, Artificial Sequence
  Description of Artificial Sequence:  synthetic
aacaggaugguaaagacuacauc

SEQ ID NO: 2255 - RNA, 23 nt, Artificial Sequence
  Description of Artificial Sequence:  synthetic
aacaggaugggaaagauuacauc

SEQ ID NO: 2256 - RNA, 23 nt, Artificial Sequence
  Description of Artificial Sequence:  synthetic
agcaggauggcaaagacuauauu

SEQ ID NO: 2257 - RNA, 23 nt, Artificial Sequence
  Description of Artificial Sequence:  synthetic
gcaggauggcaaagacuacauug

SEQ ID NO: 2258 - RNA, 23 nt, Artificial Sequence
  Description of Artificial Sequence:  synthetic
acaggaugguaaagacuacaucc

SEQ ID NO: 2259 - RNA, 23 nt, Artificial Sequence
  Description of Artificial Sequence:  synthetic
acaggaugggaaagauuacaucc

SEQ ID NO: 2260 - RNA, 23 nt, Artificial Sequence
  Description of Artificial Sequence:  synthetic
gcaggauggcaaagacuauauug

SEQ ID NO: 2261 - RNA, 12 nt, Artificial Sequence
  Description of Artificial Sequence:  synthetic
cuccuccccggc

SEQ ID NO: 2262 - RNA, 12 nt, Artificial Sequence
  Description of Artificial Sequence:  synthetic
ggagccgcgaga

SEQ ID NO: 2263 - RNA, 12 nt, Artificial Sequence
  Description of Artificial Sequence:  synthetic
ggccggcggcgg

SEQ ID NO: 2264 - RNA, 10 nt, Artificial Sequence
  Description of Artificial Sequence:  synthetic
gcggcggcga

SEQ ID NO: 2265 - RNA, 11 nt, Artificial Sequence
  Description of Artificial Sequence:  synthetic
uacccugauga

SEQ ID NO: 2266 - RNA, 10 nt, Artificial Sequence
  Description of Artificial Sequence:  synthetic
ggcuagcacc

SEQ ID NO: 2267 - RNA, 10 nt, Artificial Sequence
  Description of Artificial Sequence:  synthetic
agagggggcc

SEQ ID NO: 2268 - RNA, 12 nt, Artificial Sequence
  Description of Artificial Sequence:  synthetic
agcagcgaaagc

SEQ ID NO: 2269 - RNA, 11 nt, Artificial Sequence
  Description of Artificial Sequence:  synthetic
aggaagaggag

SEQ ID NO: 2270 - RNA, 10 nt, Artificial Sequence
  Description of Artificial Sequence:  synthetic
ccaggaguac

SEQ ID NO: 2271 - RNA, 10 nt, Artificial Sequence
  Description of Artificial Sequence:  synthetic
ccgcccccag

SEQ ID NO: 2272 - RNA, 10 nt, Artificial Sequence
  Description of Artificial Sequence:  synthetic
gugggccuug

SEQ ID NO: 2273 - RNA, 10 nt, Artificial Sequence
  Description of Artificial Sequence:  synthetic
cuuggggaga

SEQ ID NO: 2274 - RNA, 10 nt, Artificial Sequence
  Description of Artificial Sequence:  synthetic
ccucuucuuu

SEQ ID NO: 2275 - RNA, 10 nt, Artificial Sequence
  Description of Artificial Sequence:  synthetic
aagugaguga

SEQ ID NO: 2276 - RNA, 11 nt, Artificial Sequence
  Description of Artificial Sequence:  synthetic
ggaggaagagu

SEQ ID NO: 2277 - RNA, 11 nt, Artificial Sequence
  Description of Artificial Sequence:  synthetic
acaaaugugaa

SEQ ID NO: 2278 - RNA, 10 nt, Artificial Sequence
  Description of Artificial Sequence:  synthetic
gcccacugag

SEQ ID NO: 2279 - RNA, 10 nt, Artificial Sequence
  Description of Artificial Sequence:  synthetic
gccuugcuca

SEQ ID NO: 2280 - RNA, 10 nt, Artificial Sequence
  Description of Artificial Sequence:  synthetic
gaggaaggag

SEQ ID NO: 2281 - RNA, 10 nt, Artificial Sequence
  Description of Artificial Sequence:  synthetic
uuuggaaacc

SEQ ID NO: 2282 - RNA, 11 nt, Artificial Sequence
  Description of Artificial Sequence:  synthetic
ggaggaggaag

SEQ ID NO: 2283 - RNA, 10 nt, Artificial Sequence
  Description of Artificial Sequence:  synthetic
cggacagugg

SEQ ID NO: 2284 - RNA, 10 nt, Artificial Sequence
  Description of Artificial Sequence:  synthetic
ucccaggcug

SEQ ID NO: 2285 - RNA, 23 nt, Artificial Sequence
  Description of Artificial Sequence:  synthetic
gcugucugcuucucacaggaucu

SEQ ID NO: 2286 - RNA, 23 nt, Artificial Sequence
  Description of Artificial Sequence:  synthetic
gaaggagaggaccugaaacuguc

SEQ ID NO: 2287 - RNA, 23 nt, Artificial Sequence
  Description of Artificial Sequence:  synthetic
aaggagaggaccugaaacugucu

SEQ ID NO: 2288 - RNA, 23 nt, Artificial Sequence
  Description of Artificial Sequence:  synthetic
gcauuuggcauuaagaaaucacc

SEQ ID NO: 2289 - RNA, 23 nt, Artificial Sequence
  Description of Artificial Sequence:  synthetic
aacugaguuuaaaaggcacccag

SEQ ID NO: 2290 - RNA, 23 nt, Artificial Sequence
  Description of Artificial Sequence:  synthetic
aagcaaggagggccucugauggu

SEQ ID NO: 2291 - RNA, 23 nt, Artificial Sequence
  Description of Artificial Sequence:  synthetic
agccuggaaagaaucaaaaccuu

SEQ ID NO: 2292 - RNA, 23 nt, Artificial Sequence
  Description of Artificial Sequence:  synthetic
aacaaccacaaaauacaacaaga

SEQ ID NO: 2293 - RNA, 19 nt, Artificial Sequence
  Description of Artificial Sequence:  synthetic
caugcuggacugcuggcac

SEQ ID NO: 2294 - RNA, 19 nt, Artificial Sequence
  Description of Artificial Sequence:  synthetic
augcuggacugcuggcaca

SEQ ID NO: 2295 - RNA, 19 nt, Artificial Sequence
  Description of Artificial Sequence:  synthetic
ugcuggacugcuggcacag

SEQ ID NO: 2296 - RNA, 23 nt, Artificial Sequence
  Description of Artificial Sequence:  synthetic
cugaacugaguuuaaaaggcacc

SEQ ID NO: 2297 - RNA, 23 nt, Artificial Sequence
  Description of Artificial Sequence:  synthetic
ugaacugaguuuaaaaggcaccc

SEQ ID NO: 2298 - RNA, 23 nt, Artificial Sequence
  Description of Artificial Sequence:  synthetic
gaacugaguuuaaaaggcaccca

SEQ ID NO: 2299 - RNA, 23 nt, Artificial Sequence
  Description of Artificial Sequence:  synthetic
acugaguuuaaaaggcacccagc

SEQ ID NO: 2300 - RNA, 23 nt, Artificial Sequence
  Description of Artificial Sequence:  synthetic
cugaguuuaaaaggcacccagca

SEQ ID NO: 2301 - RNA, 23 nt, Artificial Sequence
  Description of Artificial Sequence:  synthetic
ugaguuuaaaaggcacccagcac

SEQ ID NO: 2302 - RNA, 23 nt, Artificial Sequence
  Description of Artificial Sequence:  synthetic
gaguuuaaaaggcacccagcaca

SEQ ID NO: 2303 - RNA, 23 nt, Artificial Sequence
  Description of Artificial Sequence:  synthetic
ucguguaaggaguggaccaucau

SEQ ID NO: 2304 - RNA, 23 nt, Artificial Sequence
  Description of Artificial Sequence:  synthetic
uuacggaguauugcugugggaaa

SEQ ID NO: 2305 - RNA, 23 nt, Artificial Sequence
  Description of Artificial Sequence:  synthetic
uagcaggccuaagacaugugagg

SEQ ID NO: 2306 - RNA, 23 nt, Artificial Sequence
  Description of Artificial Sequence:  synthetic
agcaaaaagcaagggagaaaaga

SEQ ID NO: 2307 - RNA, 23 nt, Artificial Sequence
  Description of Artificial Sequence:  synthetic
accucacugccacucuaauuguc

SEQ ID NO: 2308 - RNA, 23 nt, Artificial Sequence
  Description of Artificial Sequence:  synthetic
ccucacugccacucuaauuguca

SEQ ID NO: 2309 - RNA, 23 nt, Artificial Sequence
  Description of Artificial Sequence:  synthetic
cucacugccacucuaauugucaa

SEQ ID NO: 2310 - RNA, 23 nt, Artificial Sequence
  Description of Artificial Sequence:  synthetic
aagaccccgucucuauaccaacc

SEQ ID NO: 2311 - RNA, 23 nt, Artificial Sequence
  Description of Artificial Sequence:  synthetic
gagcgggcuccggggcucgggug

SEQ ID NO: 2312 - RNA, 23 nt, Artificial Sequence
  Description of Artificial Sequence:  synthetic
cuggcuggagccgcgagacgggc

SEQ ID NO: 2313 - RNA, 23 nt, Artificial Sequence
  Description of Artificial Sequence:  synthetic
uggcuggagccgcgagacgggcg

SEQ ID NO: 2314 - RNA, 23 nt, Artificial Sequence
  Description of Artificial Sequence:  synthetic
cauggucagcuacugggacaccg

SEQ ID NO: 2315 - RNA, 23 nt, Artificial Sequence
  Description of Artificial Sequence:  synthetic
auggucagcuacugggacaccgg

SEQ ID NO: 2316 - RNA, 23 nt, Artificial Sequence
  Description of Artificial Sequence:  synthetic
aguuuaaaaggcacccagcacau

SEQ ID NO: 2317 - RNA, 23 nt, Artificial Sequence
  Description of Artificial Sequence:  synthetic
agcagcccauaaauggucuuugc

SEQ ID NO: 2318 - RNA, 23 nt, Artificial Sequence
  Description of Artificial Sequence:  synthetic
ucaaagaagaaggaaacagaauc

SEQ ID NO: 2319 - RNA, 23 nt, Artificial Sequence
  Description of Artificial Sequence:  synthetic
caaagaagaaggaaacagaaucu

SEQ ID NO: 2320 - RNA, 23 nt, Artificial Sequence
  Description of Artificial Sequence:  synthetic
agcucgucauucccugccggguu

SEQ ID NO: 2321 - RNA, 23 nt, Artificial Sequence
  Description of Artificial Sequence:  synthetic
gcucgucauucccugccggguua

SEQ ID NO: 2322 - RNA, 23 nt, Artificial Sequence
  Description of Artificial Sequence:  synthetic
aaaaaaguuuccacuugacacuu

SEQ ID NO: 2323 - RNA, 23 nt, Artificial Sequence
  Description of Artificial Sequence:  synthetic
aaaaaguuuccacuugacacuuu

SEQ ID NO: 2324 - RNA, 23 nt, Artificial Sequence
  Description of Artificial Sequence:  synthetic
aacgcauaaucugggacaguaga

SEQ ID NO: 2325 - RNA, 23 nt, Artificial Sequence
  Description of Artificial Sequence:  synthetic
acgcauaaucugggacaguagaa

SEQ ID NO: 2326 - RNA, 23 nt, Artificial Sequence
  Description of Artificial Sequence:  synthetic
cgcauaaucugggacaguagaaa

SEQ ID NO: 2327 - RNA, 23 nt, Artificial Sequence
  Description of Artificial Sequence:  synthetic
gcauaaucugggacaguagaaag

SEQ ID NO: 2328 - RNA, 23 nt, Artificial Sequence
  Description of Artificial Sequence:  synthetic
caccucagugcauauauaugaua

SEQ ID NO: 2329 - RNA, 23 nt, Artificial Sequence
  Description of Artificial Sequence:  synthetic
cugaagaggaugcagggaauuau

SEQ ID NO: 2330 - RNA, 23 nt, Artificial Sequence
  Description of Artificial Sequence:  synthetic
uuacgaaaaggccgugucaucgu

SEQ ID NO: 2331 - RNA, 23 nt, Artificial Sequence
  Description of Artificial Sequence:  synthetic
aaucaagugguucuggcaccccu

SEQ ID NO: 2332 - RNA, 23 nt, Artificial Sequence
  Description of Artificial Sequence:  synthetic
accauaaucauuccgaagcaagg

SEQ ID NO: 2333 - RNA, 23 nt, Artificial Sequence
  Description of Artificial Sequence:  synthetic
gacugugggaagaaacauaagcu

SEQ ID NO: 2334 - RNA, 23 nt, Artificial Sequence
  Description of Artificial Sequence:  synthetic
aaccucagugaucacacaguggc

SEQ ID NO: 2335 - RNA, 23 nt, Artificial Sequence
  Description of Artificial Sequence:  synthetic
accucagugaucacacaguggcc

SEQ ID NO: 2336 - RNA, 23 nt, Artificial Sequence
  Description of Artificial Sequence:  synthetic
agagccuggaauuauuuuaggac

SEQ ID NO: 2337 - RNA, 23 nt, Artificial Sequence
  Description of Artificial Sequence:  synthetic
acagaagaggaugaaggugucua

SEQ ID NO: 2338 - RNA, 23 nt, Artificial Sequence
  Description of Artificial Sequence:  synthetic
ucuaaucuggagcugaucacucu

SEQ ID NO: 2339 - RNA, 23 nt, Artificial Sequence
  Description of Artificial Sequence:  synthetic
aucuggagcugaucacucuaaca

SEQ ID NO: 2340 - RNA, 23 nt, Artificial Sequence
  Description of Artificial Sequence:  synthetic
agcaagugggaguuugcccggga

SEQ ID NO: 2341 - RNA, 23 nt, Artificial Sequence
  Description of Artificial Sequence:  synthetic
cauuaagaaaucaccuacgugcc

SEQ ID NO: 2342 - RNA, 23 nt, Artificial Sequence
  Description of Artificial Sequence:  synthetic
ugauggugauuguugaauacugc

SEQ ID NO: 2343 - RNA, 23 nt, Artificial Sequence
  Description of Artificial Sequence:  synthetic
gaaagaaaaaauggagccaggcc

SEQ ID NO: 2344 - RNA, 23 nt, Artificial Sequence
  Description of Artificial Sequence:  synthetic
aacaaggcaagaaaccaagacua

SEQ ID NO: 2345 - RNA, 23 nt, Artificial Sequence
  Description of Artificial Sequence:  synthetic
acaaggcaagaaaccaagacuag

SEQ ID NO: 2346 - RNA, 23 nt, Artificial Sequence
  Description of Artificial Sequence:  synthetic
gagugauguugaggaagaggagg

SEQ ID NO: 2347 - RNA, 23 nt, Artificial Sequence
  Description of Artificial Sequence:  synthetic
agugauguugaggaagaggagga

SEQ ID NO: 2348 - RNA, 23 nt, Artificial Sequence
  Description of Artificial Sequence:  synthetic
cuuacaguuuucaaguggccaga

SEQ ID NO: 2349 - RNA, 23 nt, Artificial Sequence
  Description of Artificial Sequence:  synthetic
uuacaguuuucaaguggccagag

SEQ ID NO: 2350 - RNA, 23 nt, Artificial Sequence
  Description of Artificial Sequence:  synthetic
uuuucaaguggccagaggcaugg

SEQ ID NO: 2351 - RNA, 23 nt, Artificial Sequence
  Description of Artificial Sequence:  synthetic
uuucaaguggccagaggcaugga

SEQ ID NO: 2352 - RNA, 23 nt, Artificial Sequence
  Description of Artificial Sequence:  synthetic
uccagaaagugcauucaucggga

SEQ ID NO: 2353 - RNA, 23 nt, Artificial Sequence
  Description of Artificial Sequence:  synthetic
agcgagaaacauucuuuuaucug

SEQ ID NO: 2354 - RNA, 23 nt, Artificial Sequence
  Description of Artificial Sequence:  synthetic
gcgagaaacauucuuuuaucuga

SEQ ID NO: 2355 - RNA, 23 nt, Artificial Sequence
  Description of Artificial Sequence:  synthetic
cgagaaacauucuuuuaucugag

SEQ ID NO: 2356 - RNA, 23 nt, Artificial Sequence
  Description of Artificial Sequence:  synthetic
uugcugugggaaaucuucuccuu

SEQ ID NO: 2357 - RNA, 23 nt, Artificial Sequence
  Description of Artificial Sequence:  synthetic
ugccuucucugaggacuucuuca

SEQ ID NO: 2358 - RNA, 23 nt, Artificial Sequence
  Description of Artificial Sequence:  synthetic
ucaggaagcucugaugaugucag

SEQ ID NO: 2359 - RNA, 23 nt, Artificial Sequence
  Description of Artificial Sequence:  synthetic
caggaagcucugaugaugucaga

SEQ ID NO: 2360 - RNA, 23 nt, Artificial Sequence
  Description of Artificial Sequence:  synthetic
ucaaguucaugagccuggaaaga

SEQ ID NO: 2361 - RNA, 23 nt, Artificial Sequence
  Description of Artificial Sequence:  synthetic
caaguucaugagccuggaaagaa

SEQ ID NO: 2362 - RNA, 23 nt, Artificial Sequence
  Description of Artificial Sequence:  synthetic
ugagccuggaaagaaucaaaacc

SEQ ID NO: 2363 - RNA, 23 nt, Artificial Sequence
  Description of Artificial Sequence:  synthetic
cagcugugggcacgucagcgaag

SEQ ID NO: 2364 - RNA, 23 nt, Artificial Sequence
  Description of Artificial Sequence:  synthetic
cgaaggcaagcgcagguucaccu

SEQ ID NO: 2365 - RNA, 23 nt, Artificial Sequence
  Description of Artificial Sequence:  synthetic
ugcagcccaaaacccagggcaac

SEQ ID NO: 2366 - RNA, 23 nt, Artificial Sequence
  Description of Artificial Sequence:  synthetic
gaggcaagaaaaggacaaauauc

SEQ ID NO: 2367 - RNA, 23 nt, Artificial Sequence
  Description of Artificial Sequence:  synthetic
uuggcuccucuaguaagaugcac

SEQ ID NO: 2368 - RNA, 23 nt, Artificial Sequence
  Description of Artificial Sequence:  synthetic
gucuccaggccaugauggccuua

SEQ ID NO: 2369 - RNA, 23 nt, Artificial Sequence
  Description of Artificial Sequence:  synthetic
ucuccaggccaugauggccuuac

SEQ ID NO: 2370 - RNA, 23 nt, Artificial Sequence
  Description of Artificial Sequence:  synthetic
agaccccgucucuauaccaacca

SEQ ID NO: 2371 - RNA, 23 nt, Artificial Sequence
  Description of Artificial Sequence:  synthetic
accccgucucuauaccaaccaaa

SEQ ID NO: 2372 - RNA, 23 nt, Artificial Sequence
  Description of Artificial Sequence:  synthetic
ccccgucucuauaccaaccaaac

SEQ ID NO: 2373 - RNA, 23 nt, Artificial Sequence
  Description of Artificial Sequence:  synthetic
gaucaagugggccuuggaucgcu

SEQ ID NO: 2374 - RNA, 23 nt, Artificial Sequence
  Description of Artificial Sequence:  synthetic
aucaagugggccuuggaucgcua

SEQ ID NO: 2375 - RNA, 23 nt, Artificial Sequence
  Description of Artificial Sequence:  synthetic
aaaacaaccacaaaauacaacaa

SEQ ID NO: 2376 - RNA, 23 nt, Artificial Sequence
  Description of Artificial Sequence:  synthetic
caaccacaaaauacaacaagagc

SEQ ID NO: 2377 - RNA, 23 nt, Artificial Sequence
  Description of Artificial Sequence:  synthetic
cuggaauuauuuuaggaccagga

SEQ ID NO: 2378 - RNA, 23 nt, Artificial Sequence
  Description of Artificial Sequence:  synthetic
agcacgcuguuuauugaaagagu

SEQ ID NO: 2379 - RNA, 23 nt, Artificial Sequence
  Description of Artificial Sequence:  synthetic
gcacgcuguuuauugaaagaguc

SEQ ID NO: 2380 - RNA, 23 nt, Artificial Sequence
  Description of Artificial Sequence:  synthetic
cacgcuguuuauugaaagaguca

SEQ ID NO: 2381 - RNA, 23 nt, Artificial Sequence
  Description of Artificial Sequence:  synthetic
acgcuguuuauugaaagagucac

SEQ ID NO: 2382 - RNA, 23 nt, Artificial Sequence
  Description of Artificial Sequence:  synthetic
cgcuguuuauugaaagagucaca

SEQ ID NO: 2383 - RNA, 23 nt, Artificial Sequence
  Description of Artificial Sequence:  synthetic
gcuguuuauugaaagagucacag

SEQ ID NO: 2384 - RNA, 23 nt, Artificial Sequence
  Description of Artificial Sequence:  synthetic
cuguuuauugaaagagucacaga

SEQ ID NO: 2385 - RNA, 23 nt, Artificial Sequence
  Description of Artificial Sequence:  synthetic
uguuuauugaaagagucacagaa

SEQ ID NO: 2386 - RNA, 23 nt, Artificial Sequence
  Description of Artificial Sequence:  synthetic
gaugccagcaagugggaguuugc

SEQ ID NO: 2387 - RNA, 23 nt, Artificial Sequence
  Description of Artificial Sequence:  synthetic
ugccagcaagugggaguuugccc

SEQ ID NO: 2388 - RNA, 23 nt, Artificial Sequence
  Description of Artificial Sequence:  synthetic
cagcauuuggcauuaagaaauca

SEQ ID NO: 2389 - RNA, 23 nt, Artificial Sequence
  Description of Artificial Sequence:  synthetic
agcauuuggcauuaagaaaucac

SEQ ID NO: 2390 - RNA, 23 nt, Artificial Sequence
  Description of Artificial Sequence:  synthetic
cauuuggcauuaagaaaucaccu

SEQ ID NO: 2391 - RNA, 23 nt, Artificial Sequence
  Description of Artificial Sequence:  synthetic
auuuggcauuaagaaaucaccua

SEQ ID NO: 2392 - RNA, 23 nt, Artificial Sequence
  Description of Artificial Sequence:  synthetic
cgugccggacuguggcugugaaa

SEQ ID NO: 2393 - RNA, 23 nt, Artificial Sequence
  Description of Artificial Sequence:  synthetic
gcgaguacaaagcucugaugacu

SEQ ID NO: 2394 - RNA, 23 nt, Artificial Sequence
  Description of Artificial Sequence:  synthetic
cgaguacaaagcucugaugacug

SEQ ID NO: 2395 - RNA, 23 nt, Artificial Sequence
  Description of Artificial Sequence:  synthetic
ccaagcaaggagggccucugaug

SEQ ID NO: 2396 - RNA, 23 nt, Artificial Sequence
  Description of Artificial Sequence:  synthetic
agcaaggagggccucugauggug

SEQ ID NO: 2397 - RNA, 23 nt, Artificial Sequence
  Description of Artificial Sequence:  synthetic
caaggagggccucugauggugau

SEQ ID NO: 2398 - RNA, 23 nt, Artificial Sequence
  Description of Artificial Sequence:  synthetic
aaggagggccucugauggugauu

SEQ ID NO: 2399 - RNA, 23 nt, Artificial Sequence
  Description of Artificial Sequence:  synthetic
aggagggccucugauggugauug

SEQ ID NO: 2400 - RNA, 23 nt, Artificial Sequence
  Description of Artificial Sequence:  synthetic
uucaaguggccagaggcauggag

SEQ ID NO: 2401 - RNA, 23 nt, Artificial Sequence
  Description of Artificial Sequence:  synthetic
ucaaguggccagaggcauggagu

SEQ ID NO: 2402 - RNA, 23 nt, Artificial Sequence
  Description of Artificial Sequence:  synthetic
aguggccagaggcauggaguucc

SEQ ID NO: 2403 - RNA, 23 nt, Artificial Sequence
  Description of Artificial Sequence:  synthetic
gagccuggaaagaaucaaaaccu

SEQ ID NO: 2404 - RNA, 23 nt, Artificial Sequence
  Description of Artificial Sequence:  synthetic
uuuuuugacuaacaagaauguaa

SEQ ID NO: 2405 - RNA, 23 nt, Artificial Sequence
  Description of Artificial Sequence:  synthetic
ugaccuuggagcaucucaucugu

SEQ ID NO: 2406 - RNA, 23 nt, Artificial Sequence
  Description of Artificial Sequence:  synthetic
ucaccuguuuccuguauggagga

SEQ ID NO: 2407 - RNA, 23 nt, Artificial Sequence
  Description of Artificial Sequence:  synthetic
uuugagcauggaagaggauucug

SEQ ID NO: 2408 - RNA, 23 nt, Artificial Sequence
  Description of Artificial Sequence:  synthetic
gacaacacagcaggaaucaguca

SEQ ID NO: 2409 - RNA, 23 nt, Artificial Sequence
  Description of Artificial Sequence:  synthetic
uguccacuuaccugaggagcaag

SEQ ID NO: 2410 - RNA, 23 nt, Artificial Sequence
  Description of Artificial Sequence:  synthetic
augguucuugccucagaagagcu

SEQ ID NO: 2411 - RNA, 23 nt, Artificial Sequence
  Description of Artificial Sequence:  synthetic
ucugaaggcucaaaccagacaag

SEQ ID NO: 2412 - RNA, 19 nt, Artificial Sequence
  Description of Artificial Sequence:  synthetic
ccuuaugaugccagcaaau

SEQ ID NO: 2413 - RNA, 19 nt, Artificial Sequence
  Description of Artificial Sequence:  synthetic
cuuaugaugccagcaaaug

SEQ ID NO: 2414 - RNA, 19 nt, Artificial Sequence
  Description of Artificial Sequence:  synthetic
uuaugaugccagcaaaugg

SEQ ID NO: 2415 - RNA, 19 nt, Artificial Sequence
  Description of Artificial Sequence:  synthetic
uaugaugccagcaaauggg

SEQ ID NO: 2416 - RNA, 19 nt, Artificial Sequence
  Description of Artificial Sequence:  synthetic
augaugccagcaaauggga

SEQ ID NO: 2417 - RNA, 19 nt, Artificial Sequence
  Description of Artificial Sequence:  synthetic
cagaccaugcuggacugcu

SEQ ID NO: 2418 - RNA, 19 nt, Artificial Sequence
  Description of Artificial Sequence:  synthetic
agaccaugcuggacugcug

SEQ ID NO: 2419 - RNA, 19 nt, Artificial Sequence
  Description of Artificial Sequence:  synthetic
gaccaugcuggacugcugg

SEQ ID NO: 2420 - RNA, 19 nt, Artificial Sequence
  Description of Artificial Sequence:  synthetic
accaugcuggacugcuggc

SEQ ID NO: 2421 - RNA, 19 nt, Artificial Sequence
  Description of Artificial Sequence:  synthetic
ccaugcuggacugcuggca

SEQ ID NO: 2422 - RNA, 19 nt, Artificial Sequence
  Description of Artificial Sequence:  synthetic
caggauggcaaagacuaca

SEQ ID NO: 2423 - RNA, 19 nt, Artificial Sequence
  Description of Artificial Sequence:  synthetic
aggauggcaaagacuacau

SEQ ID NO: 2424 - RNA, 23 nt, Artificial Sequence
  Description of Artificial Sequence:  synthetic
aacagaauuuccugggacagcaa

SEQ ID NO: 2425 - RNA, 23 nt, Artificial Sequence
  Description of Artificial Sequence:  synthetic
uggagcaucucaucuguuacagc

SEQ ID NO: 2426 - RNA, 23 nt, Artificial Sequence
  Description of Artificial Sequence:  synthetic
cacguuuucagaguugguggaac

SEQ ID NO: 2427 - RNA, 23 nt, Artificial Sequence
  Description of Artificial Sequence:  synthetic
cucaccuguuuccuguauggagg

SEQ ID NO: 2428 - RNA, 23 nt, Artificial Sequence
  Description of Artificial Sequence:  synthetic
ucagaguggcagugagcaaaggg

SEQ ID NO: 2429 - RNA, 23 nt, Artificial Sequence
  Description of Artificial Sequence:  synthetic
ccgcagaaaguccgucuggcagc

SEQ ID NO: 2430 - RNA, 23 nt, Artificial Sequence
  Description of Artificial Sequence:  synthetic
cgcagaaaguccgucuggcagcc

SEQ ID NO: 2431 - RNA, 23 nt, Artificial Sequence
  Description of Artificial Sequence:  synthetic
gcagaaaguccgucuggcagccu

SEQ ID NO: 2432 - RNA, 23 nt, Artificial Sequence
  Description of Artificial Sequence:  synthetic
uggcagccuggauauccucuccu

SEQ ID NO: 2433 - RNA, 23 nt, Artificial Sequence
  Description of Artificial Sequence:  synthetic
ggcagccuggauauccucuccua

SEQ ID NO: 2434 - RNA, 23 nt, Artificial Sequence
  Description of Artificial Sequence:  synthetic
cccgggcucccuagcccugugcg

SEQ ID NO: 2435 - RNA, 23 nt, Artificial Sequence
  Description of Artificial Sequence:  synthetic
ccgggcucccuagcccugugcgc

SEQ ID NO: 2436 - RNA, 23 nt, Artificial Sequence
  Description of Artificial Sequence:  synthetic
ccuccuucucuagacaggcgcug

SEQ ID NO: 2437 - RNA, 23 nt, Artificial Sequence
  Description of Artificial Sequence:  synthetic
cuccuucucuagacaggcgcugg

SEQ ID NO: 2438 - RNA, 23 nt, Artificial Sequence
  Description of Artificial Sequence:  synthetic
uccuucucuagacaggcgcuggg

SEQ ID NO: 2439 - RNA, 23 nt, Artificial Sequence
  Description of Artificial Sequence:  synthetic
aggguggaggugacugagugcag

SEQ ID NO: 2440 - RNA, 23 nt, Artificial Sequence
  Description of Artificial Sequence:  synthetic
ggguggaggugacugagugcagc

SEQ ID NO: 2441 - RNA, 23 nt, Artificial Sequence
  Description of Artificial Sequence:  synthetic
gcuggcauggucuucugugaagc

SEQ ID NO: 2442 - RNA, 23 nt, Artificial Sequence
  Description of Artificial Sequence:  synthetic
cuggcauggucuucugugaagca

SEQ ID NO: 2443 - RNA, 23 nt, Artificial Sequence
  Description of Artificial Sequence:  synthetic
ugaagcaaaaauuaaugaugaaa

SEQ ID NO: 2444 - RNA, 23 nt, Artificial Sequence
  Description of Artificial Sequence:  synthetic
gaagcaaaaauuaaugaugaaag

SEQ ID NO: 2445 - RNA, 23 nt, Artificial Sequence
  Description of Artificial Sequence:  synthetic
ccaagaagaacagcacauuuguc

SEQ ID NO: 2446 - RNA, 23 nt, Artificial Sequence
  Description of Artificial Sequence:  synthetic
agcacauuugucaggguccauga

SEQ ID NO: 2447 - RNA, 23 nt, Artificial Sequence
  Description of Artificial Sequence:  synthetic
aguggcauggaaucucuggugga

SEQ ID NO: 2448 - RNA, 23 nt, Artificial Sequence
  Description of Artificial Sequence:  synthetic
aaucucugguggaagccacggug

SEQ ID NO: 2449 - RNA, 23 nt, Artificial Sequence
  Description of Artificial Sequence:  synthetic
ggucucucugguuguguaugucc

SEQ ID NO: 2450 - RNA, 23 nt, Artificial Sequence
  Description of Artificial Sequence:  synthetic
gucucucugguuguguauguccc

SEQ ID NO: 2451 - RNA, 23 nt, Artificial Sequence
  Description of Artificial Sequence:  synthetic
uaaucucuccuguggauuccuac

SEQ ID NO: 2452 - RNA, 23 nt, Artificial Sequence
  Description of Artificial Sequence:  synthetic
aaucucuccuguggauuccuacc

SEQ ID NO: 2453 - RNA, 23 nt, Artificial Sequence
  Description of Artificial Sequence:  synthetic
gugucagcuuuguacaaauguga

SEQ ID NO: 2454 - RNA, 23 nt, Artificial Sequence
  Description of Artificial Sequence:  synthetic
gacaagacagcaacuugcaggac

SEQ ID NO: 2455 - RNA, 23 nt, Artificial Sequence
  Description of Artificial Sequence:  synthetic
acaagacagcaacuugcaggaca

SEQ ID NO: 2456 - RNA, 23 nt, Artificial Sequence
  Description of Artificial Sequence:  synthetic
caagacagcaacuugcaggacag

SEQ ID NO: 2457 - RNA, 23 nt, Artificial Sequence
  Description of Artificial Sequence:  synthetic
cucauggugauuguggaauucug

SEQ ID NO: 2458 - RNA, 23 nt, Artificial Sequence
  Description of Artificial Sequence:  synthetic
ucauggugauuguggaauucugc

SEQ ID NO: 2459 - RNA, 23 nt, Artificial Sequence
  Description of Artificial Sequence:  synthetic
ucccucagugauguagaagaaga

SEQ ID NO: 2460 - RNA, 23 nt, Artificial Sequence
  Description of Artificial Sequence:  synthetic
agaagaagaggaagcuccugaag

SEQ ID NO: 2461 - RNA, 23 nt, Artificial Sequence
  Description of Artificial Sequence:  synthetic
gaagaagaggaagcuccugaaga

SEQ ID NO: 2462 - RNA, 23 nt, Artificial Sequence
  Description of Artificial Sequence:  synthetic
agaggaagcuccugaagaucugu

SEQ ID NO: 2463 - RNA, 23 nt, Artificial Sequence
  Description of Artificial Sequence:  synthetic
gaggaagcuccugaagaucugua

SEQ ID NO: 2464 - RNA, 23 nt, Artificial Sequence
  Description of Artificial Sequence:  synthetic
agggcauggaguucuuggcaucg

SEQ ID NO: 2465 - RNA, 23 nt, Artificial Sequence
  Description of Artificial Sequence:  synthetic
uugcugugggaaauauuuuccuu

SEQ ID NO: 2466 - RNA, 23 nt, Artificial Sequence
  Description of Artificial Sequence:  synthetic
ugcugugggaaauauuuuccuua

SEQ ID NO: 2467 - RNA, 23 nt, Artificial Sequence
  Description of Artificial Sequence:  synthetic
cauggaagaggauucuggacucu

SEQ ID NO: 2468 - RNA, 23 nt, Artificial Sequence
  Description of Artificial Sequence:  synthetic
gacucucucugccuaccucaccu

SEQ ID NO: 2469 - RNA, 23 nt, Artificial Sequence
  Description of Artificial Sequence:  synthetic
acucucucugccuaccucaccug

SEQ ID NO: 2470 - RNA, 23 nt, Artificial Sequence
  Description of Artificial Sequence:  synthetic
aagcugauagagauuggagugca

SEQ ID NO: 2471 - RNA, 23 nt, Artificial Sequence
  Description of Artificial Sequence:  synthetic
agcugauagagauuggagugcaa

SEQ ID NO: 2472 - RNA, 23 nt, Artificial Sequence
  Description of Artificial Sequence:  synthetic
gcacagcccagauucuccagccu

SEQ ID NO: 2473 - RNA, 23 nt, Artificial Sequence
  Description of Artificial Sequence:  synthetic
cacagcccagauucuccagccug

SEQ ID NO: 2474 - RNA, 23 nt, Artificial Sequence
  Description of Artificial Sequence:  synthetic
acagcccagauucuccagccuga

SEQ ID NO: 2475 - RNA, 23 nt, Artificial Sequence
  Description of Artificial Sequence:  synthetic
cagcccagauucuccagccugac

SEQ ID NO: 2476 - RNA, 23 nt, Artificial Sequence
  Description of Artificial Sequence:  synthetic
agcucuccuccuguuuaaaagga

SEQ ID NO: 2477 - RNA, 23 nt, Artificial Sequence
  Description of Artificial Sequence:  synthetic
uauccuggaagaggcuugugacc

SEQ ID NO: 2478 - RNA, 23 nt, Artificial Sequence
  Description of Artificial Sequence:  synthetic
auccuggaagaggcuugugaccc

SEQ ID NO: 2479 - RNA, 23 nt, Artificial Sequence
  Description of Artificial Sequence:  synthetic
uccuggaagaggcuugugaccca

SEQ ID NO: 2480 - RNA, 23 nt, Artificial Sequence
  Description of Artificial Sequence:  synthetic
uggaagaggcuugugacccaaga

SEQ ID NO: 2481 - RNA, 23 nt, Artificial Sequence
  Description of Artificial Sequence:  synthetic
uguugaagaugggaaggauuugc

SEQ ID NO: 2482 - RNA, 23 nt, Artificial Sequence
  Description of Artificial Sequence:  synthetic
ucugguggaggugggcauggggu

SEQ ID NO: 2483 - RNA, 23 nt, Artificial Sequence
  Description of Artificial Sequence:  synthetic
ucguugugcuguuucugacuccu

SEQ ID NO: 2484 - RNA, 23 nt, Artificial Sequence
  Description of Artificial Sequence:  synthetic
cguugugcuguuucugacuccua

SEQ ID NO: 2485 - RNA, 23 nt, Artificial Sequence
  Description of Artificial Sequence:  synthetic
guugugcuguuucugacuccuaa

SEQ ID NO: 2486 - RNA, 23 nt, Artificial Sequence
  Description of Artificial Sequence:  synthetic
ucaaaguuucaggaaggauuuua

SEQ ID NO: 2487 - RNA, 23 nt, Artificial Sequence
  Description of Artificial Sequence:  synthetic
caaaguuucaggaaggauuuuac

SEQ ID NO: 2488 - RNA, 23 nt, Artificial Sequence
  Description of Artificial Sequence:  synthetic
aaaguuucaggaaggauuuuacc

SEQ ID NO: 2489 - RNA, 23 nt, Artificial Sequence
  Description of Artificial Sequence:  synthetic
ucaaaaaagaaaauguguuuuuu

SEQ ID NO: 2490 - RNA, 23 nt, Artificial Sequence
  Description of Artificial Sequence:  synthetic
cuauucacauuuuguaucaguau

SEQ ID NO: 2491 - RNA, 23 nt, Artificial Sequence
  Description of Artificial Sequence:  synthetic
uauucacauuuuguaucaguauu

SEQ ID NO: 2492 - RNA, 23 nt, Artificial Sequence
  Description of Artificial Sequence:  synthetic
auucacauuuuguaucaguauua

SEQ ID NO: 2493 - RNA, 23 nt, Artificial Sequence
  Description of Artificial Sequence:  synthetic
ggccgccucuguggguuugccua

SEQ ID NO: 2494 - RNA, 23 nt, Artificial Sequence
  Description of Artificial Sequence:  synthetic
gccgccucuguggguuugccuag

SEQ ID NO: 2495 - RNA, 23 nt, Artificial Sequence
  Description of Artificial Sequence:  synthetic
acccagaaaagagauuuguuccu

SEQ ID NO: 2496 - RNA, 23 nt, Artificial Sequence
  Description of Artificial Sequence:  synthetic
guaacagaauuuccugggacagc

SEQ ID NO: 2497 - RNA, 23 nt, Artificial Sequence
  Description of Artificial Sequence:  synthetic
agcuugucuuaaauuguacagca

SEQ ID NO: 2498 - RNA, 23 nt, Artificial Sequence
  Description of Artificial Sequence:  synthetic
gaaggaaaaaacaaaacuguaag

SEQ ID NO: 2499 - RNA, 23 nt, Artificial Sequence
  Description of Artificial Sequence:  synthetic
aaggaaaaaacaaaacuguaagu

SEQ ID NO: 2500 - RNA, 23 nt, Artificial Sequence
  Description of Artificial Sequence:  synthetic
accagggguccugaaauuacuuu

SEQ ID NO: 2501 - RNA, 23 nt, Artificial Sequence
  Description of Artificial Sequence:  synthetic
aagaccaagaaaagacauugcgu

SEQ ID NO: 2502 - RNA, 23 nt, Artificial Sequence
  Description of Artificial Sequence:  synthetic
aggccucuacaccugccaggcau

SEQ ID NO: 2503 - RNA, 23 nt, Artificial Sequence
  Description of Artificial Sequence:  synthetic
gauugccauguucuucuggcuac

SEQ ID NO: 2504 - RNA, 23 nt, Artificial Sequence
  Description of Artificial Sequence:  synthetic
ggaggggaacugaagacaggcua

SEQ ID NO: 2505 - RNA, 23 nt, Artificial Sequence
  Description of Artificial Sequence:  synthetic
ggggaacugaagacaggcuacuu

SEQ ID NO: 2506 - RNA, 23 nt, Artificial Sequence
  Description of Artificial Sequence:  synthetic
gggaacugaagacaggcuacuug

SEQ ID NO: 2507 - RNA, 23 nt, Artificial Sequence
  Description of Artificial Sequence:  synthetic
ggaacugaagacaggcuacuugu

SEQ ID NO: 2508 - RNA, 23 nt, Artificial Sequence
  Description of Artificial Sequence:  synthetic
aacugaagacaggcuacuugucc

SEQ ID NO: 2509 - RNA, 23 nt, Artificial Sequence
  Description of Artificial Sequence:  synthetic
acugccuuaugaugccagcaaau

SEQ ID NO: 2510 - RNA, 23 nt, Artificial Sequence
  Description of Artificial Sequence:  synthetic
ggcgcuuggacagcaucaccagu

SEQ ID NO: 2511 - RNA, 23 nt, Artificial Sequence
  Description of Artificial Sequence:  synthetic
uaaggacuuccugaccuuggagc

SEQ ID NO: 2512 - RNA, 23 nt, Artificial Sequence
  Description of Artificial Sequence:  synthetic
accuuggagcaucucaucuguua

SEQ ID NO: 2513 - RNA, 23 nt, Artificial Sequence
  Description of Artificial Sequence:  synthetic
cuuggagcaucucaucuguuaca

SEQ ID NO: 2514 - RNA, 23 nt, Artificial Sequence
  Description of Artificial Sequence:  synthetic
uuggagcaucucaucuguuacag

SEQ ID NO: 2515 - RNA, 23 nt, Artificial Sequence
  Description of Artificial Sequence:  synthetic
gagcaucucaucuguuacagcuu

SEQ ID NO: 2516 - RNA, 23 nt, Artificial Sequence
  Description of Artificial Sequence:  synthetic
caucuguuacagcuuccaagugg

SEQ ID NO: 2517 - RNA, 23 nt, Artificial Sequence
  Description of Artificial Sequence:  synthetic
uguuacagcuuccaaguggcuaa

SEQ ID NO: 2518 - RNA, 23 nt, Artificial Sequence
  Description of Artificial Sequence:  synthetic
uccaaguggcuaagggcauggag

SEQ ID NO: 2519 - RNA, 23 nt, Artificial Sequence
  Description of Artificial Sequence:  synthetic
gggcauggaguucuuggcaucgc

SEQ ID NO: 2520 - RNA, 23 nt, Artificial Sequence
  Description of Artificial Sequence:  synthetic
gagcauggaagaggauucuggac

SEQ ID NO: 2521 - RNA, 23 nt, Artificial Sequence
  Description of Artificial Sequence:  synthetic
agcauggaagaggauucuggacu

SEQ ID NO: 2522 - RNA, 23 nt, Artificial Sequence
  Description of Artificial Sequence:  synthetic
cucugccuaccucaccuguuucc

SEQ ID NO: 2523 - RNA, 23 nt, Artificial Sequence
  Description of Artificial Sequence:  synthetic
ucugccuaccucaccuguuuccu

SEQ ID NO: 2524 - RNA, 23 nt, Artificial Sequence
  Description of Artificial Sequence:  synthetic
cugccuaccucaccuguuuccug

SEQ ID NO: 2525 - RNA, 23 nt, Artificial Sequence
  Description of Artificial Sequence:  synthetic
ccucaccuguuuccuguauggag

SEQ ID NO: 2526 - RNA, 23 nt, Artificial Sequence
  Description of Artificial Sequence:  synthetic
aaauuccauuaugacaacacagc

SEQ ID NO: 2527 - RNA, 23 nt, Artificial Sequence
  Description of Artificial Sequence:  synthetic
uccauuaugacaacacagcagga

SEQ ID NO: 2528 - RNA, 23 nt, Artificial Sequence
  Description of Artificial Sequence:  synthetic
agcacugccacaagaaguaccug

SEQ ID NO: 2529 - RNA, 23 nt, Artificial Sequence
  Description of Artificial Sequence:  synthetic
cugaagcagagagagagaaggca

SEQ ID NO: 2530 - RNA, 23 nt, Artificial Sequence
  Description of Artificial Sequence:  synthetic
aaagaggaaccaggaggacaaga

SEQ ID NO: 2531 - RNA, 23 nt, Artificial Sequence
  Description of Artificial Sequence:  synthetic
gacaagaggagcaugaaagugga

SEQ ID NO: 2532 - RNA, 23 nt, Artificial Sequence
  Description of Artificial Sequence:  synthetic
acuucuaugugaccaccaucccc

SEQ ID NO: 2533 - RNA, 23 nt, Artificial Sequence
  Description of Artificial Sequence:  synthetic
caagcacugccacaagaaguacc

SEQ ID NO: 2534 - RNA, 23 nt, Artificial Sequence
  Description of Artificial Sequence:  synthetic
aguacggcaaccucuccaacuuc

SEQ ID NO: 2535 - RNA, 23 nt, Artificial Sequence
  Description of Artificial Sequence:  synthetic
cugccauguacaagugugugguc

SEQ ID NO: 2536 - RNA, 23 nt, Artificial Sequence
  Description of Artificial Sequence:  synthetic
acugccacaagaaguaccugucg

SEQ ID NO: 2537 - RNA, 23 nt, Artificial Sequence
  Description of Artificial Sequence:  synthetic
uggugaagaucugugacuuuggc

SEQ ID NO: 2538 - RNA, 23 nt, Artificial Sequence
  Description of Artificial Sequence:  synthetic
gaagaucugugacuuuggccuug

SEQ ID NO: 2539 - RNA, 23 nt, Artificial Sequence
  Description of Artificial Sequence:  synthetic
gcaagagcuccagagagaagucg

SEQ ID NO: 2540 - RNA, 23 nt, Artificial Sequence
  Description of Artificial Sequence:  synthetic
caaagugagugaccugcuuuugg

SEQ ID NO: 2541 - RNA, 23 nt, Artificial Sequence
  Description of Artificial Sequence:  synthetic
acgaaguggugaaguucauggau

SEQ ID NO: 2542 - RNA, 23 nt, Artificial Sequence
  Description of Artificial Sequence:  synthetic
gguggacaucuuccaggaguacc

SEQ ID NO: 2543 - RNA, 23 nt, Artificial Sequence
  Description of Artificial Sequence:  synthetic
guggacaucuuccaggaguaccc

SEQ ID NO: 2544 - RNA, 23 nt, Artificial Sequence
  Description of Artificial Sequence:  synthetic
ggacaucuuccaggaguacccug

SEQ ID NO: 2545 - RNA, 23 nt, Artificial Sequence
  Description of Artificial Sequence:  synthetic
aguccaacaucaccaugcagauu

SEQ ID NO: 2546 - RNA, 23 nt, Artificial Sequence
  Description of Artificial Sequence:  synthetic
cgaacguacuugcagaugugaca

SEQ ID NO: 2547 - RNA, 23 nt, Artificial Sequence
  Description of Artificial Sequence:  synthetic
agacccugguggacaucuuccag

SEQ ID NO: 2548 - RNA, 23 nt, Artificial Sequence
  Description of Artificial Sequence:  synthetic
uaugcggaucaaaccucaccaag

SEQ ID NO: 2549 - RNA, 23 nt, Artificial Sequence
  Description of Artificial Sequence:  synthetic
aaaugugaaugcagaccaaagaa

SEQ ID NO: 2550 - RNA, 23 nt, Artificial Sequence
  Description of Artificial Sequence:  synthetic
aaugugaaugcagaccaaagaaa

SEQ ID NO: 2551 - RNA, 23 nt, Artificial Sequence
  Description of Artificial Sequence:  synthetic
augugaaugcagaccaaagaaag

SEQ ID NO: 2552 - RNA, 23 nt, Artificial Sequence
  Description of Artificial Sequence:  synthetic
gugaaugcagaccaaagaaagau

SEQ ID NO: 2553 - RNA, 23 nt, Artificial Sequence
  Description of Artificial Sequence:  synthetic
cagacguguaaauguuccugcaa

SEQ ID NO: 2554 - RNA, 23 nt, Artificial Sequence
  Description of Artificial Sequence:  synthetic
cguguaaauguuccugcaaaaac

SEQ ID NO: 2555 - RNA, 23 nt, Artificial Sequence
  Description of Artificial Sequence:  synthetic
guguaaauguuccugcaaaaaca

SEQ ID NO: 2556 - RNA, 23 nt, Artificial Sequence
  Description of Artificial Sequence:  synthetic
uguaaauguuccugcaaaaacac

SEQ ID NO: 2557 - RNA, 23 nt, Artificial Sequence
  Description of Artificial Sequence:  synthetic
guaaauguuccugcaaaaacaca

SEQ ID NO: 2558 - RNA, 23 nt, Artificial Sequence
  Description of Artificial Sequence:  synthetic
cugcaaaaacacagacucgcguu

SEQ ID NO: 2559 - RNA, 23 nt, Artificial Sequence
  Description of Artificial Sequence:  synthetic
gcagcuugaguuaaacgaacgua

SEQ ID NO: 2560 - RNA, 23 nt, Artificial Sequence
  Description of Artificial Sequence:  synthetic
cguacuugcagaugugacaagcc

SEQ ID NO: 2561 - RNA, 23 nt, Artificial Sequence
  Description of Artificial Sequence:  synthetic
gagacccugguggacaucuucca

SEQ ID NO: 2562 - RNA, 23 nt, Artificial Sequence
  Description of Artificial Sequence:  synthetic
gacccugguggacaucuuccagg

SEQ ID NO: 2563 - RNA, 23 nt, Artificial Sequence
  Description of Artificial Sequence:  synthetic
ucagagcggagaaagcauuuguu

SEQ ID NO: 2564 - RNA, 23 nt, Artificial Sequence
  Description of Artificial Sequence:  synthetic
auccgcagacguguaaauguucc

SEQ ID NO: 2565 - RNA, 23 nt, Artificial Sequence
  Description of Artificial Sequence:  synthetic
ccgcagacguguaaauguuccug

SEQ ID NO: 2566 - RNA, 23 nt, Artificial Sequence
  Description of Artificial Sequence:  synthetic
cgcagacguguaaauguuccugc

SEQ ID NO: 2567 - RNA, 23 nt, Artificial Sequence
  Description of Artificial Sequence:  synthetic
gacguguaaauguuccugcaaaa

SEQ ID NO: 2568 - RNA, 23 nt, Artificial Sequence
  Description of Artificial Sequence:  synthetic
uaaauguuccugcaaaaacacag

SEQ ID NO: 2569 - RNA, 23 nt, Artificial Sequence
  Description of Artificial Sequence:  synthetic
aaauguuccugcaaaaacacaga

SEQ ID NO: 2570 - RNA, 23 nt, Artificial Sequence
  Description of Artificial Sequence:  synthetic
uccugcaaaaacacagacucgcg

SEQ ID NO: 2571 - RNA, 23 nt, Artificial Sequence
  Description of Artificial Sequence:  synthetic
ccugcaaaaacacagacucgcgu

SEQ ID NO: 2572 - RNA, 23 nt, Artificial Sequence
  Description of Artificial Sequence:  synthetic
aggcgaggcagcuugaguuaaac

SEQ ID NO: 2573 - RNA, 23 nt, Artificial Sequence
  Description of Artificial Sequence:  synthetic
cgaggcagcuugaguuaaacgaa

SEQ ID NO: 2574 - RNA, 23 nt, Artificial Sequence
  Description of Artificial Sequence:  synthetic
gaggcagcuugaguuaaacgaac

SEQ ID NO: 2575 - RNA, 23 nt, Artificial Sequence
  Description of Artificial Sequence:  synthetic
aggcagcuugaguuaaacgaacg

SEQ ID NO: 2576 - RNA, 23 nt, Artificial Sequence
  Description of Artificial Sequence:  synthetic
ggcagcuugaguuaaacgaacgu

SEQ ID NO: 2577 - RNA, 23 nt, Artificial Sequence
  Description of Artificial Sequence:  synthetic
uaaacgaacguacuugcagaugu

SEQ ID NO: 2578 - RNA, 23 nt, Artificial Sequence
  Description of Artificial Sequence:  synthetic
aaacgaacguacuugcagaugug

SEQ ID NO: 2579 - RNA, 23 nt, Artificial Sequence
  Description of Artificial Sequence:  synthetic
aaaccucaccaaggccagcacau

SEQ ID NO: 2580 - RNA, 23 nt, Artificial Sequence
  Description of Artificial Sequence:  synthetic
agagagacggggucagagagagc

SEQ ID NO: 2581 - RNA, 23 nt, Artificial Sequence
  Description of Artificial Sequence:  synthetic
aaagcauuuguuuguacaagauc

SEQ ID NO: 2582 - RNA, 23 nt, Artificial Sequence
  Description of Artificial Sequence:  synthetic
ucccucuucuuuuuucuuaaaca

SEQ ID NO: 2583 - RNA, 23 nt, Artificial Sequence
  Description of Artificial Sequence:  synthetic
cccucuucuuuuuucuuaaacau

SEQ ID NO: 2584 - RNA, 23 nt, Artificial Sequence
  Description of Artificial Sequence:  synthetic
ccucuucuuuuuucuuaaacauu

SEQ ID NO: 2585 - RNA, 23 nt, Artificial Sequence
  Description of Artificial Sequence:  synthetic
ucuucuuuuuucuuaaacauuuu

SEQ ID NO: 2586 - RNA, 23 nt, Artificial Sequence
  Description of Artificial Sequence:  synthetic
ucuuuuuucuuaaacauuuuuuu

SEQ ID NO: 2587 - RNA, 23 nt, Artificial Sequence
  Description of Artificial Sequence:  synthetic
uuuuuucuuaaacauuuuuuuuu

SEQ ID NO: 2588 - RNA, 23 nt, Artificial Sequence
  Description of Artificial Sequence:  synthetic
uuuuucuuaaacauuuuuuuuua

SEQ ID NO: 2589 - RNA, 23 nt, Artificial Sequence
  Description of Artificial Sequence:  synthetic
aacauuuuuuuuuaaaacuguau

SEQ ID NO: 2590 - RNA, 23 nt, Artificial Sequence
  Description of Artificial Sequence:  synthetic
uuuuuuuaaaacuguauuguuuc

SEQ ID NO: 2591 - RNA, 23 nt, Artificial Sequence
  Description of Artificial Sequence:  synthetic
uuuuuuaaaacuguauuguuucu

SEQ ID NO: 2592 - RNA, 23 nt, Artificial Sequence
  Description of Artificial Sequence:  synthetic
uuaaaacuguauuguuucucguu

SEQ ID NO: 2593 - RNA, 23 nt, Artificial Sequence
  Description of Artificial Sequence:  synthetic
auuguuucucguuuuaauuuauu

SEQ ID NO: 2594 - RNA, 23 nt, Artificial Sequence
  Description of Artificial Sequence:  synthetic
uuauuuuugcuugccauucccca

SEQ ID NO: 2595 - RNA, 23 nt, Artificial Sequence
  Description of Artificial Sequence:  synthetic
uccccacuugaaucgggccgacg

SEQ ID NO: 2596 - RNA, 23 nt, Artificial Sequence
  Description of Artificial Sequence:  synthetic
ccccacuugaaucgggccgacgg

SEQ ID NO: 2597 - RNA, 23 nt, Artificial Sequence
  Description of Artificial Sequence:  synthetic
cuccagagagaagucgaggaaga

SEQ ID NO: 2598 - RNA, 23 nt, Artificial Sequence
  Description of Artificial Sequence:  synthetic
uccagagagaagucgaggaagag

SEQ ID NO: 2599 - RNA, 23 nt, Artificial Sequence
  Description of Artificial Sequence:  synthetic
gucagagagagcgcgcgggcgug

SEQ ID NO: 2600 - RNA, 23 nt, Artificial Sequence
  Description of Artificial Sequence:  synthetic
gcagcugaccagucgcgcugacg

SEQ ID NO: 2601 - RNA, 23 nt, Artificial Sequence
  Description of Artificial Sequence:  synthetic
ggccggagcccgcgcccggaggc

SEQ ID NO: 2602 - RNA, 23 nt, Artificial Sequence
  Description of Artificial Sequence:  synthetic
gccggagcccgcgcccggaggcg

SEQ ID NO: 2603 - RNA, 23 nt, Artificial Sequence
  Description of Artificial Sequence:  synthetic
ccggagcccgcgcccggaggcgg

SEQ ID NO: 2604 - RNA, 23 nt, Artificial Sequence
  Description of Artificial Sequence:  synthetic
cacugaaacuuuucguccaacuu

SEQ ID NO: 2605 - RNA, 23 nt, Artificial Sequence
  Description of Artificial Sequence:  synthetic
acugaaacuuuucguccaacuuc

SEQ ID NO: 2606 - RNA, 23 nt, Artificial Sequence
  Description of Artificial Sequence:  synthetic
cugaaacuuuucguccaacuucu

SEQ ID NO: 2607 - RNA, 23 nt, Artificial Sequence
  Description of Artificial Sequence:  synthetic
aacuuuucguccaacuucugggc

SEQ ID NO: 2608 - RNA, 23 nt, Artificial Sequence
  Description of Artificial Sequence:  synthetic
cuucugggcuguucucgcuucgg

SEQ ID NO: 2609 - RNA, 23 nt, Artificial Sequence
  Description of Artificial Sequence:  synthetic
ucugggcuguucucgcuucggag

SEQ ID NO: 2610 - RNA, 23 nt, Artificial Sequence
  Description of Artificial Sequence:  synthetic
ucggaggagccgugguccgcgcg

SEQ ID NO: 2611 - RNA, 23 nt, Artificial Sequence
  Description of Artificial Sequence:  synthetic
cggaggagccgugguccgcgcgg

SEQ ID NO: 2612 - RNA, 23 nt, Artificial Sequence
  Description of Artificial Sequence:  synthetic
ccgggaggagccgcagccggagg

SEQ ID NO: 2613 - RNA, 23 nt, Artificial Sequence
  Description of Artificial Sequence:  synthetic
cgggaggagccgcagccggagga

SEQ ID NO: 2614 - RNA, 23 nt, Artificial Sequence
  Description of Artificial Sequence:  synthetic
gggaggagccgcagccggaggag

SEQ ID NO: 2615 - RNA, 23 nt, Artificial Sequence
  Description of Artificial Sequence:  synthetic
gaagagaaggaagaggagagggg

SEQ ID NO: 2616 - RNA, 23 nt, Artificial Sequence
  Description of Artificial Sequence:  synthetic
gugcuccagccgcgcgcgcuccc

SEQ ID NO: 2617 - RNA, 23 nt, Artificial Sequence
  Description of Artificial Sequence:  synthetic
gccccacagcccgagccggagag

SEQ ID NO: 2618 - RNA, 23 nt, Artificial Sequence
  Description of Artificial Sequence:  synthetic
ccccacagcccgagccggagagg

SEQ ID NO: 2619 - RNA, 23 nt, Artificial Sequence
  Description of Artificial Sequence:  synthetic
accaugaacuuucugcugucuug

SEQ ID NO: 2620 - RNA, 23 nt, Artificial Sequence
  Description of Artificial Sequence:  synthetic
gaacuuucugcugucuugggugc

SEQ ID NO: 2621 - RNA, 23 nt, Artificial Sequence
  Description of Artificial Sequence:  synthetic
ucugcugucuugggugcauugga

SEQ ID NO: 2622 - RNA, 23 nt, Artificial Sequence
  Description of Artificial Sequence:  synthetic
ggugcauuggagccuugccuugc

SEQ ID NO: 2623 - RNA, 23 nt, Artificial Sequence
  Description of Artificial Sequence:  synthetic
gccuugccuugcugcucuaccuc

SEQ ID NO: 2624 - RNA, 23 nt, Artificial Sequence
  Description of Artificial Sequence:  synthetic
ucaccuccaccaugccaaguggu

SEQ ID NO: 2625 - RNA, 23 nt, Artificial Sequence
  Description of Artificial Sequence:  synthetic
cuccuccaccaugccaagugguc

SEQ ID NO: 2626 - RNA, 23 nt, Artificial Sequence
  Description of Artificial Sequence:  synthetic
caccaugccaaguggucccaggc

SEQ ID NO: 2627 - RNA, 23 nt, Artificial Sequence
  Description of Artificial Sequence:  synthetic
ucccaggcugcacccauggcaga

SEQ ID NO: 2628 - RNA, 23 nt, Artificial Sequence
  Description of Artificial Sequence:  synthetic
auucuaucagcgcagcuacugcc

SEQ ID NO: 2629 - RNA, 23 nt, Artificial Sequence
  Description of Artificial Sequence:  synthetic
caucuuccaggaguacccugaug

SEQ ID NO: 2630 - RNA, 23 nt, Artificial Sequence
  Description of Artificial Sequence:  synthetic
caucuucaagccauccugugugc

SEQ ID NO: 2631 - RNA, 23 nt, Artificial Sequence
  Description of Artificial Sequence:  synthetic
cuaaugacgagggccuggagugu

SEQ ID NO: 2632 - RNA, 23 nt, Artificial Sequence
  Description of Artificial Sequence:  synthetic
cgggccuggagugugugcccacu

SEQ ID NO: 2633 - RNA, 23 nt, Artificial Sequence
  Description of Artificial Sequence:  synthetic
cccacugaggaguccaacaucac

SEQ ID NO: 2634 - RNA, 23 nt, Artificial Sequence
  Description of Artificial Sequence:  synthetic
uccaacaucaccaugcagauuau

SEQ ID NO: 2635 - RNA, 23 nt, Artificial Sequence
  Description of Artificial Sequence:  synthetic
acaucaccaugcagauuaugcgg

SEQ ID NO: 2636 - RNA, 23 nt, Artificial Sequence
  Description of Artificial Sequence:  synthetic
ugcagauuaugcggaucaaaccu

SEQ ID NO: 2637 - RNA, 23 nt, Artificial Sequence
  Description of Artificial Sequence:  synthetic
gcagauuaugcggaucaaaccuc

SEQ ID NO: 2638 - RNA, 23 nt, Artificial Sequence
  Description of Artificial Sequence:  synthetic
cagauuaugcggaucaaaccuca

SEQ ID NO: 2639 - RNA, 23 nt, Artificial Sequence
  Description of Artificial Sequence:  synthetic
auaggagagaugagcuuccuaca

SEQ ID NO: 2640 - RNA, 23 nt, Artificial Sequence
  Description of Artificial Sequence:  synthetic
gagagcuuccuacagcacaacaa

SEQ ID NO: 2641 - RNA, 23 nt, Artificial Sequence
  Description of Artificial Sequence:  synthetic
agcuuccuacagcacaacaaaug

SEQ ID NO: 2642 - RNA, 23 nt, Artificial Sequence
  Description of Artificial Sequence:  synthetic
ccacagcacaacaaaugugaaug

SEQ ID NO: 2643 - RNA, 23 nt, Artificial Sequence
  Description of Artificial Sequence:  synthetic
uacagcacaacaaaugugaaugc

SEQ ID NO: 2644 - RNA, 23 nt, Artificial Sequence
  Description of Artificial Sequence:  synthetic
acaaaugugaaugcagaccaaag

SEQ ID NO: 2645 - RNA, 23 nt, Artificial Sequence
  Description of Artificial Sequence:  synthetic
uaccuccaccaugccaagugguc

SEQ ID NO: 2646 - RNA, 23 nt, Artificial Sequence
  Description of Artificial Sequence:  synthetic
accuccaccaugccaaguggucc

SEQ ID NO: 2647 - RNA, 23 nt, Artificial Sequence
  Description of Artificial Sequence:  synthetic
accaugccaaguggucccaggcu

SEQ ID NO: 2648 - RNA, 23 nt, Artificial Sequence
  Description of Artificial Sequence:  synthetic
ccaugccaaguggucccaggcug

SEQ ID NO: 2649 - RNA, 23 nt, Artificial Sequence
  Description of Artificial Sequence:  synthetic
caugccaaguggucccaggcugc

SEQ ID NO: 2650 - RNA, 23 nt, Artificial Sequence
  Description of Artificial Sequence:  synthetic
augccaaguggucccaggcugca

SEQ ID NO: 2651 - RNA, 23 nt, Artificial Sequence
  Description of Artificial Sequence:  synthetic
ugccaaguggucccaggcugcac

SEQ ID NO: 2652 - RNA, 23 nt, Artificial Sequence
  Description of Artificial Sequence:  synthetic
aaguggucccaggcugcacccau

SEQ ID NO: 2653 - RNA, 23 nt, Artificial Sequence
  Description of Artificial Sequence:  synthetic
aguggucccaggcugcacccaug

SEQ ID NO: 2654 - RNA, 23 nt, Artificial Sequence
  Description of Artificial Sequence:  synthetic
ugaaugcagaccaaagaaagaua

SEQ ID NO: 2655 - RNA, 23 nt, Artificial Sequence
  Description of Artificial Sequence:  synthetic
gcucagagcggagaaagcauuug

SEQ ID NO: 2656 - RNA, 23 nt, Artificial Sequence
  Description of Artificial Sequence:  synthetic
aauguuccugcaaaaacacagac

SEQ ID NO: 2657 - RNA, 23 nt, Artificial Sequence
  Description of Artificial Sequence:  synthetic
auguuccugcaaaaacacagacu

SEQ ID NO: 2658 - RNA, 23 nt, Artificial Sequence
  Description of Artificial Sequence:  synthetic
uguuccugcaaaaacacagacuc

SEQ ID NO: 2659 - RNA, 23 nt, Artificial Sequence
  Description of Artificial Sequence:  synthetic
guuccugcaaaaacacagacucg

SEQ ID NO: 2660 - RNA, 23 nt, Artificial Sequence
  Description of Artificial Sequence:  synthetic
ugcaaaaacacagacucgcguug

SEQ ID NO: 2661 - RNA, 23 nt, Artificial Sequence
  Description of Artificial Sequence:  synthetic
aaaaacacagacucgcguugcaa

SEQ ID NO: 2662 - RNA, 23 nt, Artificial Sequence
  Description of Artificial Sequence:  synthetic
acacagacucgcguugcaaggcg

SEQ ID NO: 2663 - RNA, 23 nt, Artificial Sequence
  Description of Artificial Sequence:  synthetic
agacucgcguugcaaggcgaggc

SEQ ID NO: 2664 - RNA, 23 nt, Artificial Sequence
  Description of Artificial Sequence:  synthetic
gcguugcaaggcgaggcagcuug

SEQ ID NO: 2665 - RNA, 23 nt, Artificial Sequence
  Description of Artificial Sequence:  synthetic
ugcaaggcgaggcagcuugaguu

SEQ ID NO: 2666 - RNA, 23 nt, Artificial Sequence
  Description of Artificial Sequence:  synthetic
caaggcgaggcagcuugaguuaa

SEQ ID NO: 2667 - RNA, 23 nt, Artificial Sequence
  Description of Artificial Sequence:  synthetic
ugaguuaaacgaacguacuugca

SEQ ID NO: 2668 - RNA, 23 nt, Artificial Sequence
  Description of Artificial Sequence:  synthetic
aguuaaacgaacguacuugcaga

SEQ ID NO: 2669 - RNA, 23 nt, Artificial Sequence
  Description of Artificial Sequence:  synthetic
guuaaacgaacguacuugcagau

SEQ ID NO: 2670 - RNA, 23 nt, Artificial Sequence
  Description of Artificial Sequence:  synthetic
uuaaacgaacguacuugcagaug

SEQ ID NO: 2671 - RNA, 23 nt, Artificial Sequence
  Description of Artificial Sequence:  synthetic
acguacuugcagaugugacaagc

SEQ ID NO: 2672 - RNA, 23 nt, Artificial Sequence
  Description of Artificial Sequence:  synthetic
guacuugcagaugugacaagccg

SEQ ID NO: 2673 - RNA, 46 nt, Artificial Sequence
  Description of Artificial Sequence:  synthetic
accucacugccacucuaauugucccucacugccacucuaauuguca

SEQ ID NO: 2674 - RNA, 46 nt, Artificial Sequence
  Description of Artificial Sequence:  synthetic
ccucacugccacucuaauugucaccucacugccacucuaauuguca

SEQ ID NO: 2675 - RNA, 46 nt, Artificial Sequence
  Description of Artificial Sequence:  synthetic
cucacugccacucuaauugucaaccucacugccacucuaauuguca

SEQ ID NO: 2676 - RNA, 46 nt, Artificial Sequence
  Description of Artificial Sequence:  synthetic
aaagcauuuguuuguacaagaucucaugcuggacugcuggcacaga

SEQ ID NO: 2677 - RNA, 46 nt, Artificial Sequence
  Description of Artificial Sequence:  synthetic
agagagacggggucagagagagcaagaccccgucucuauaccaacc

SEQ ID NO: 2678 - RNA, 46 nt, Artificial Sequence
  Description of Artificial Sequence:  synthetic
accucacugccacucuaauugucucagaguggcagugagcaaaggg

SEQ ID NO: 2679 - RNA, 46 nt, Artificial Sequence
  Description of Artificial Sequence:  synthetic
ccucacugccacucuaauugucaucagaguggcagugagcaaaggg

SEQ ID NO: 2680 - RNA, 46 nt, Artificial Sequence
  Description of Artificial Sequence:  synthetic
cucacugccacucuaauugucaaucagaguggcagugagcaaaggg

SEQ ID NO: 2681 - RNA, 46 nt, Artificial Sequence
  Description of Artificial Sequence:  synthetic
aaugugaaugcagaccaaagaaaucaugcuggacugcuggcacaga

SEQ ID NO: 2682 - RNA, 46 nt, Artificial Sequence
  Description of Artificial Sequence:  synthetic
augugaaugcagaccaaagaaagucaugcuggacugcuggcacaga

SEQ ID NO: 2683 - RNA, 46 nt, Artificial Sequence
  Description of Artificial Sequence:  synthetic
guggacaucuuccaggaguaccccugaacugaguuuaaaaggcacc

SEQ ID NO: 2684 - RNA, 46 nt, Artificial Sequence
  Description of Artificial Sequence:  synthetic
augugaaugcagaccaaagaaagcugaacugaguuuaaaaggcacc

SEQ ID NO: 2685 - RNA, 46 nt, Artificial Sequence
  Description of Artificial Sequence:  synthetic
uuugagcauggaagaggauucugcugaacugaguuuaaaaggcacc

SEQ ID NO: 2686 - RNA, 46 nt, Artificial Sequence
  Description of Artificial Sequence:  synthetic
cugaacugaguuuaaaaggcaccaugugaaugcagaccaaagaaag

SEQ ID NO: 2687 - RNA, 46 nt, Artificial Sequence
  Description of Artificial Sequence:  synthetic
ucaugcuggacugcuggcacagaaugugaaugcagaccaaagaaag

SEQ ID NO: 2688 - RNA, 46 nt, Artificial Sequence
  Description of Artificial Sequence:  synthetic
ucccucuucuuuuuucuuaaacaagaagaagaggaagcuccugaag

SEQ ID NO: 2689 - RNA, 46 nt, Artificial Sequence
  Description of Artificial Sequence:  synthetic
ccucuucuuuuuucuuaaacauuucaaagaagaaggaaacagaauc

SEQ ID NO: 2690 - RNA, 46 nt, Artificial Sequence
  Description of Artificial Sequence:  synthetic
auuguuucucguuuuaauuuauuagcgagaaacauucuuuuaucug

SEQ ID NO: 2691 - RNA, 46 nt, Artificial Sequence
  Description of Artificial Sequence:  synthetic
uccccacuugaaucgggccgacggaucaagugggccuuggaucgcu

SEQ ID NO: 2692 - RNA, 46 nt, Artificial Sequence
  Description of Artificial Sequence:  synthetic
ccccacuugaaucgggccgacgguuuucaaguggccagaggcaugg

SEQ ID NO: 2693 - RNA, 46 nt, Artificial Sequence
  Description of Artificial Sequence:  synthetic
cuccagagagaagucgaggaagaggucucucugguuguguaugucc

SEQ ID NO: 2694 - RNA, 46 nt, Artificial Sequence
  Description of Artificial Sequence:  synthetic
agagagacggggucagagagagcagaccccgucucuauaccaacca

SEQ ID NO: 2695 - RNA, 46 nt, Artificial Sequence
  Description of Artificial Sequence:  synthetic
gcagcugaccagucgcgcugacgcauggucagcuacugggacaccg

SEQ ID NO: 2696 - RNA, 46 nt, Artificial Sequence
  Description of Artificial Sequence:  synthetic
cugaaacuuuucguccaacuucuaaaaaaguuuccacuugacacuu

SEQ ID NO: 2697 - RNA, 46 nt, Artificial Sequence
  Description of Artificial Sequence:  synthetic
ccccacagcccgagccggagagguugcugugggaaaucuucuccuu

SEQ ID NO: 2698 - RNA, 46 nt, Artificial Sequence
  Description of Artificial Sequence:  synthetic
accaugaacuuucugcugucuugucaaguucaugagccuggaaaga

SEQ ID NO: 2699 - RNA, 46 nt, Artificial Sequence
  Description of Artificial Sequence:  synthetic
caccaugccaaguggucccaggcagggcauggaguucuuggcaucg

SEQ ID NO: 2700 - RNA, 46 nt, Artificial Sequence
  Description of Artificial Sequence:  synthetic
caucuucaagccauccugugugcuguugaagaugggaaggauuugc

SEQ ID NO: 2701 - RNA, 46 nt, Artificial Sequence
  Description of Artificial Sequence:  synthetic
ugcagauuaugcggaucaaaccuaacgcauaaucugggacaguaga

SEQ ID NO: 2702 - RNA, 46 nt, Artificial Sequence
  Description of Artificial Sequence:  synthetic
gcagauuaugcggaucaaaccucaacgcauaaucugggacaguaga

SEQ ID NO: 2703 - RNA, 46 nt, Artificial Sequence
  Description of Artificial Sequence:  synthetic
auaggagagaugagcuuccuacauaaucucuccuguggauuccuac

SEQ ID NO: 2704 - RNA, 46 nt, Artificial Sequence
  Description of Artificial Sequence:  synthetic
agcuuccuacagcacaacaaaugucaggaagcucugaugaugucag

SEQ ID NO: 2705 - RNA, 46 nt, Artificial Sequence
  Description of Artificial Sequence:  synthetic
uacagcacaacaaaugugaaugcucguugugcuguuucugacuccu

SEQ ID NO: 2706 - RNA, 46 nt, Artificial Sequence
  Description of Artificial Sequence:  synthetic
acaaaugugaaugcagaccaaagcuauucacauuuuguaucaguau

SEQ ID NO: 2707 - RNA, 24 nt, Artificial Sequence
  Description of Artificial Sequence:  synthetic
aguuuaaaaggcacccagcacauc

SEQ ID NO: 2708 - RNA, 23 nt, Artificial Sequence
  Description of Artificial Sequence:  synthetic
gcauauauaugauaaagcauuca

SEQ ID NO: 2709 - DNA, 21 bp, Artificial Sequence
  Description of Artificial Sequence:  synthetic
  misc_feature (1)..(19): ribonucleotide modified as described
ugucugcuucucacaggautt

SEQ ID NO: 2710 - DNA, 21 bp, Artificial Sequence
  Description of Artificial Sequence:  synthetic
  misc_feature (1)..(19): ribonucleotide modified as described
aggagaggaccugaaacugtt

SEQ ID NO: 2711 - DNA, 21 bp, Artificial Sequence
  Description of Artificial Sequence:  synthetic
  misc_feature (1)..(19): ribonucleotide modified as described
ggagaggaccugaaacugutt

SEQ ID NO: 2712 - DNA, 21 bp, Artificial Sequence
  Description of Artificial Sequence:  synthetic
  misc_feature (1)..(19): ribonucleotide modified as described
auuuggcauuaagaaaucatt

SEQ ID NO: 2713 - DNA, 21 bp, Artificial Sequence
  Description of Artificial Sequence:  synthetic
  misc_feature (1)..(19): ribonucleotide modified as described
auccugugagaagcagacatt

SEQ ID NO: 2714 - DNA, 21 bp, Artificial Sequence
  Description of Artificial Sequence:  synthetic
  misc_feature (1)..(19): ribonucleotide modified as described
caguuucagguccucuccutt

SEQ ID NO: 2715 - DNA, 21 bp, Artificial Sequence
  Description of Artificial Sequence:  synthetic
  misc_feature (1)..(19): ribonucleotide modified as described
acaguuucagguccucucctt

SEQ ID NO: 2716 - DNA, 21 bp, Artificial Sequence
  Description of Artificial Sequence:  synthetic
  misc_feature (1)..(19): ribonucleotide modified as described
ugauuucuuaaugccaaautt

SEQ ID NO: 2717 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (3)..(5): 2'-deoxy-2'-fluoro
  misc_feature (7)..(12): 2'-deoxy-2'-fluoro
  misc_feature (14)..(14): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ugucugcuucucacaggautt

SEQ ID NO: 2718 - DNA, 21 bp, Artificial Sequence
  Description of Artificial Sequence:  synthetic
  misc_feature (1)..(1): 5'-3 attached terminal deoxyabasic moeity
  misc_feature (10)..(12): 2'-deoxy-2'-fluoro
  misc_feature (17)..(18): 2'-deoxy-2'-fluoro
  misc_feature (1)..(19): ribonucleotide modified as described
  misc_feature (21)..(21): 3'-3 attached terminal deoxyabasic moeity
aggagaggaccugaaacugtt

SEQ ID NO: 2719 - DNA, 21 bp, Artificial Sequence
  Description of Artificial Sequence:  synthetic
  misc_feature (1)..(1): 5'-3 attached terminal deoxyabasic moeity
  misc_feature (9)..(11): 2'-deoxy-2'-fluoro
  misc_feature (16)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggagaggaccugaaacugutt

SEQ ID NO: 2720 - DNA, 21 bp, Artificial Sequence
  Description of Artificial Sequence:  synthetic
  misc_feature (1)..(1): 5'-3 attached terminal deoxyabasic moeity
  misc_feature (2)..(4): 2'-deoxy-2'-fluoro
  misc_feature (7)..(7): 2'-deoxy-2'-fluoro
  misc_feature (9)..(10): 2'-deoxy-2'-fluoro
  misc_feature (17)..(18): 2'-deoxy-2'-fluoro
  misc_feature (1)..(19): ribonucleotide modified as described
  misc_feature (21)..(21): 3'-3 attached terminal deoxyabasic moeity
auuuggcauuaagaaaucatt

SEQ ID NO: 2721 - DNA, 21 bp, Artificial Sequence
  Description of Artificial Sequence:  synthetic
  misc_feature (2)..(5): 2'-deoxy-2'-fluoro
  misc_feature (7)..(7): 2'-deoxy-2'-fluoro
  misc_feature (14)..(14): 2'-deoxy-2'-fluoro
  misc_feature (18)..(18): 2'-deoxy-2'-fluoro
  misc_feature (1)..(19): ribonucleotide modified as described
  misc_feature (20)..(20): Phosphorothioate 3'-Internucleotide Linkage
auccugugagaagcagacatt

SEQ ID NO: 2722 - DNA, 21 bp, Artificial Sequence
  Description of Artificial Sequence:  synthetic
  misc_feature (1)..(1): 2'-deoxy-2'-fluoro
  misc_feature (4)..(7): 2'-deoxy-2'-fluoro
  misc_feature (11)..(19): 2'-deoxy-2'-fluoro
  misc_feature (1)..(19): ribonucleotide modified as described
  misc_feature (20)..(20): Phosphorothioate 3'-Internucleotide Linkage
caguuucagguccucuccutt

SEQ ID NO: 2723 - DNA, 21 bp, Artificial Sequence
  Description of Artificial Sequence:  synthetic
  misc_feature (2)..(2): 2'-deoxy-2'-fluoro
  misc_feature (5)..(8): 2'-deoxy-2'-fluoro
  misc_feature (12)..(19): 2'-deoxy-2'-fluoro
  misc_feature (1)..(19): ribonucleotide modified as described
  misc_feature (20)..(20): Phosphorothioate 3'-Internucleotide Linkage
acaguuucagguccucucctt

SEQ ID NO: 2724 - DNA, 21 bp, Artificial Sequence
  Description of Artificial Sequence:  synthetic
  misc_feature (1)..(1): 2'-deoxy-2'-fluoro
  misc_feature (4)..(9): 2'-deoxy-2'-fluoro
  misc_feature (12)..(12): 2'-deoxy-2'-fluoro
  misc_feature (14)..(15): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
ugauuucuuaaugccaaautt

SEQ ID NO: 2725 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(5): 2'-deoxy-2'-fluoro
  misc_feature (6)..(6): 2'-deoxy
  misc_feature (7)..(12): 2'-deoxy-2'-fluoro
  misc_feature (13)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ugucugcuucucacaggautt

SEQ ID NO: 2726 - DNA, 21 bp, Artificial Sequence
  Description of Artificial Sequence:  synthetic
  misc_feature (1)..(9): 2'-deoxy
  misc_feature (1)..(1): 5'-3 attached terminal deoxyabasic moeity
  misc_feature (10)..(12): 2'-deoxy-2'-fluoro
  misc_feature (13)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aggagaggaccugaaacugtt

SEQ ID NO: 2727 - DNA, 21 bp, Artificial Sequence
  Description of Artificial Sequence:  synthetic
  misc_feature (1)..(8): 2'-deoxy
  misc_feature (1)..(1): 5'-3 attached terminal deoxyabasic moeity
  misc_feature (9)..(11): 2'-deoxy-2'-fluoro
  misc_feature (12)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggagaggaccugaaacugutt

SEQ ID NO: 2728 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(4): 2'-deoxy-2'-fluoro
  misc_feature (5)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
auuuggcauuaagaaaucatt

SEQ ID NO: 2729 - DNA, 21 bp, Artificial Sequence
  Description of Artificial Sequence:  synthetic
  misc_feature (1)..(1): 2'-deoxy
  misc_feature (2)..(5): 2'-deoxy-2'-fluoro
  misc_feature (6)..(6): 2'-deoxy
  misc_feature (7)..(7): 2'-deoxy-2'-fluoro
  misc_feature (8)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (20)..(20): Phosphorothioate 3'-Internucleotide Linkage
auccugugagaagcagacatt

SEQ ID NO: 2730 - DNA, 21 bp, Artificial Sequence
  Description of Artificial Sequence:  synthetic
  misc_feature (1)..(1): 2'-deoxy-2'-fluoro
  misc_feature (2)..(3): 2'-deoxy
  misc_feature (4)..(7): 2'-deoxy-2'-fluoro
  misc_feature (8)..(10): 2'-deoxy
  misc_feature (11)..(19): 2'-deoxy-2'-fluoro
  misc_feature (1)..(19): ribonucleotide modified as described
  misc_feature (20)..(20): Phosphorothioate 3'-Internucleotide Linkage
caguuucagguccucuccutt

SEQ ID NO: 2731 - DNA, 21 bp, Artificial Sequence
  Description of Artificial Sequence:  synthetic
  misc_feature (1)..(1): 2'-deoxy
  misc_feature (2)..(2): 2'-deoxy-2'-fluoro
  misc_feature (3)..(4): 2'-deoxy
  misc_feature (5)..(8): 2'-deoxy-2'-fluoro
  misc_feature (9)..(11): 2'-deoxy
  misc_feature (12)..(19): 2'-deoxy-2'-fluoro
  misc_feature (1)..(19): ribonucleotide modified as described
  misc_feature (20)..(20): Phosphorothioate 3'-Internucleotide Linkage
acaguuucagguccucucctt

SEQ ID NO: 2732 - DNA, 21 bp, Artificial Sequence
  Description of Artificial Sequence:  synthetic
  misc_feature (1)..(1): 2'-deoxy-2'-fluoro
  misc_feature (2)..(3): 2'-deoxy
  misc_feature (4)..(9): 2'-deoxy-2'-fluoro
  misc_feature (10)..(11): 2'-deoxy
  misc_feature (12)..(12): 2'-deoxy-2'-fluoro
  misc_feature (13)..(13): 2'-deoxy
  misc_feature (14)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
ugauuucuuaaugccaaautt

SEQ ID NO: 2733 - DNA, 21 bp, Artificial Sequence
  Description of Artificial Sequence:  inverted control/siNA sense
  misc_feature (3)..(5): 2'-deoxy-2'-fluoro
  misc_feature (9)..(14): 2'-deoxy-2'-fluoro
  misc_feature (16)..(16): 2'-deoxy-2'-fluoro
  misc_feature (1)..(19): ribonucleotide modified as described
  misc_feature (20)..(20): Phosphorothioate 3'-Internucleotide Linkage
gacucaaauuuuccgugggtt

SEQ ID NO: 2734 - DNA, 21 bp, Artificial Sequence
  Description of Artificial Sequence:  inverted control/siNA sense
  misc_feature (1)..(1): 2'-deoxy-2'-fluoro
  misc_feature (3)..(10): 2'-deoxy-2'-fluoro
  misc_feature (16)..(17): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
cguuccucccggagacuactt

SEQ ID NO: 2735 - DNA, 21 bp, Artificial Sequence
  Description of Artificial Sequence:  inverted control/siNA sense
  misc_feature (4)..(11): 2'-deoxy-2'-fluoro
  misc_feature (14)..(17): 2'-deoxy-2'-fluoro
  misc_feature (1)..(19): ribonucleotide modified as described
  misc_feature (20)..(20): Phosphorothioate 3'-Internucleotide Linkage
ggaccuuucuuaguuuuggtt

SEQ ID NO: 2736 - DNA, 21 bp, Artificial Sequence
  Description of Artificial Sequence:  inverted control/siNA sense
  misc_feature (1)..(3): 2'-deoxy-2'-fluoro
  misc_feature (1)..(1): 5'-3 attached terminal deoxyabasic moeity
  misc_feature (4)..(4): 2'-deoxy
  misc_feature (5)..(5): 2'-deoxy-2'-fluoro
  misc_feature (6)..(11): 2'-deoxy
  misc_feature (12)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cccacggaaaauuugaguctt

SEQ ID NO: 2737 - DNA, 21 bp, Artificial Sequence
  Description of Artificial Sequence:  inverted control/siNA sense
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(4): 2'-deoxy
  misc_feature (5)..(9): 2'-deoxy-2'-fluoro
  misc_feature (10)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
guagucuccgggaggaacgtt

SEQ ID NO: 2738 - DNA, 21 bp, Artificial Sequence
  Description of Artificial Sequence:  inverted control/siNA sense
  misc_feature (1)..(2): 2'-deoxy-2'-fluoro
  misc_feature (1)..(1): 5'-3 attached terminal deoxyabasic moeity
  misc_feature (3)..(6): 2'-deoxy
  misc_feature (7)..(8): 2'-deoxy-2'-fluoro
  misc_feature (9)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
ccaaaacuaagaaaggucctt

SEQ ID NO: 2739 - DNA, 21 bp, Artificial Sequence
  Description of Artificial Sequence:  inverted control/siNA sense
  misc_feature (3)..(5): 2'-deoxy-2'-fluoro
  misc_feature (9)..(14): 2'-deoxy-2'-fluoro
  misc_feature (16)..(16): 2'-deoxy-2'-fluoro
  misc_feature (1)..(19): ribonucleotide modified as described
  misc_feature (20)..(20): Phosphorothioate 3'-Internucleotide Linkage
gacucaaauuuuccgugggtt

SEQ ID NO: 2740 - DNA, 21 bp, Artificial Sequence
  Description of Artificial Sequence:  inverted control/siNA sense
  misc_feature (1)..(1): 2'-deoxy-2'-fluoro
  misc_feature (3)..(10): 2'-deoxy-2'-fluoro
  misc_feature (16)..(17): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
cguuccucccggagacuactt

SEQ ID NO: 2741 - DNA, 21 bp, Artificial Sequence
  Description of Artificial Sequence:  inverted control/siNA sense
  misc_feature (4)..(11): 2'-deoxy-2'-fluoro
  misc_feature (14)..(17): 2'-deoxy-2'-fluoro
  misc_feature (1)..(19): ribonucleotide modified as described
  misc_feature (20)..(20): Phosphorothioate 3'-Internucleotide Linkage
ggaccuuucuuaguuuuggtt

SEQ ID NO: 2742 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cugaguuuaaaaggcaccctt

SEQ ID NO: 2743 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gcaaggagggccucugaugtt

SEQ ID NO: 2744 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ccuggaaagaaucaaaacctt

SEQ ID NO: 2745 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gggugccuuuuaaacucagtt

SEQ ID NO: 2746 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
caucagaggcccuccuugctt

SEQ ID NO: 2747 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gguuuugauucuuuccaggtt

SEQ ID NO: 2748 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cccacggaaaauuugaguctt

SEQ ID NO: 2749 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
guagucuccgggaggaacgtt

SEQ ID NO: 2750 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ccaaaacuaagaaaggucctt

SEQ ID NO: 2751 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gacucaaauuuuccgugggtt

SEQ ID NO: 2752 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cguuccucccggagacuactt

SEQ ID NO: 2753 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ggaccuuucuuaguuuuggtt

SEQ ID NO: 2754 - DNA, 21 bp, Artificial Sequence
  Description of Artificial Sequence:  synthetic
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(18): 2'-deoxy-2'-fluoro
  misc_feature (19)..(19): 2'-deoxy
  misc_feature (20)..(21): n stands for 5-bromo-deoxy-uridine
  misc_feature (20)..(20): Phosphorothioate 3'-Internucleotide Linkage
uuguuguauuuugugguugtt

SEQ ID NO: 2755 - DNA, 21 bp, Artificial Sequence
  Description of Artificial Sequence:  synthetic
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(9): 2'-deoxy
  misc_feature (10)..(17): 2'-deoxy-2'-fluoro
  misc_feature (18)..(18): 2'-deoxy
  misc_feature (19)..(19): 2'-deoxy-2'-fluoro
  misc_feature (20)..(21): n stands for 5-bromo-deoxy-uridine
  misc_feature (20)..(20): Phosphorothioate 3'-Internucleotide Linkage
caucagaggcccuccuugctt

SEQ ID NO: 2756 - DNA, 21 bp, Artificial Sequence
  Description of Artificial Sequence:  synthetic
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(18): 2'-deoxy-2'-fluoro
  misc_feature (19)..(19): 2'-deoxy
  misc_feature (20)..(20): Phosphorothioate 3'-Internucleotide Linkage
  misc_feature (20)..(20): 5-bromo-deoxy-uridine
  misc_feature (1)..(20): ribonucleotide modified as described
uuguuguauuuugugguugut

SEQ ID NO: 2757 - DNA, 21 bp, Artificial Sequence
  Description of Artificial Sequence:  synthetic
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(9): 2'-deoxy
  misc_feature (10)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (20)..(20): 5-bromo-deoxy-uridine
  misc_feature (1)..(20): ribonucleotide modified as described
caucagaggcccuccuugcut

SEQ ID NO: 2758 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
caaccacaaaauacaacaatt

SEQ ID NO: 2759 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
aacaacauaaaacaccaactt

SEQ ID NO: 2760 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uuguuguauuuugugguugtt

SEQ ID NO: 2761 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
guugguguuuuauguuguutt

SEQ ID NO: 2762 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uuguuguauuuugugguugtt

SEQ ID NO: 2763 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(5): 2'-deoxy
  misc_feature (6)..(8): 2'-deoxy-2'-fluoro
  misc_feature (9)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
cugaguuuaaaaggcaccctt

SEQ ID NO: 2764 - DNA, 21 bp, Artificial Sequence
  Description of Artificial Sequence:  inverted control
  misc_feature (1)..(1): 5'-3 attached terminal deoxyabasic moeity
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(11): 2'-deoxy
  misc_feature (12)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cccacggaaaauuugaguctt

SEQ ID NO: 2765 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
cugaguuuaaaaggcaccctt

SEQ ID NO: 2766 - DNA, 21 bp, Artificial Sequence
  Description of Artificial Sequence:  inverted control
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
cccacggaaaauuugaguctt

SEQ ID NO: 2767 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(5): 2'-deoxy
  misc_feature (6)..(8): 2'-deoxy-2'-fluoro
  misc_feature (9)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
cugaguuuaaaaggcaccctt

SEQ ID NO: 2768 - DNA, 21 bp, Artificial Sequence
  Description of Artificial Sequence:  inverted control
  misc_feature (1)..(1): 5'-3 attached terminal deoxyabasic moeity
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(11): 2'-deoxy
  misc_feature (12)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cccacggaaaauuugaguctt

SEQ ID NO: 2769 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
cugaguuuaaaaggcaccctt

SEQ ID NO: 2770 - DNA, 21 bp, Artificial Sequence
  Description of Artificial Sequence:  inverted control
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
cccacggaaaauuugaguctt

SEQ ID NO: 2771 - DNA, 21 bp, Artificial Sequence
  Description of Artificial Sequence:  synthetic
  misc_feature (1)..(19): ribonucleotide modified as described
caugcuggacugcuggcactt

SEQ ID NO: 2772 - DNA, 21 bp, Artificial Sequence
  Description of Artificial Sequence:  synthetic
  misc_feature (1)..(19): ribonucleotide modified as described
augcuggacugcuggcacatt

SEQ ID NO: 2773 - DNA, 21 bp, Artificial Sequence
  Description of Artificial Sequence:  synthetic
  misc_feature (1)..(19): ribonucleotide modified as described
ugcuggacugcuggcacagtt

SEQ ID NO: 2774 - DNA, 21 bp, Artificial Sequence
  Description of Artificial Sequence:  synthetic
  misc_feature (1)..(19): ribonucleotide modified as described
gugccagcaguccagcaugtt

SEQ ID NO: 2775 - DNA, 21 bp, Artificial Sequence
  Description of Artificial Sequence:  synthetic
  misc_feature (1)..(19): ribonucleotide modified as described
ugugccagcaguccagcautt

SEQ ID NO: 2776 - DNA, 21 bp, Artificial Sequence
  Description of Artificial Sequence:  synthetic
  misc_feature (1)..(19): ribonucleotide modified as described
cugugccagcaguccagcatt

SEQ ID NO: 2777 - DNA, 21 bp, Artificial Sequence
  Description of Artificial Sequence:  synthetic
  misc_feature (3)..(5): 2'-O-methyl
  misc_feature (9)..(14): 2'-O-methyl
  misc_feature (16)..(16): 2'-O-methyl
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cugaguuuaaaaggcaccctt

SEQ ID NO: 2778 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (6)..(8): 2'-deoxy-2'-fluoro
  misc_feature (15)..(15): 2'-deoxy-2'-fluoro
  misc_feature (17)..(19): 2'-deoxy-2'-fluoro
  misc_feature (3)..(5): 2'-O-methyl
  misc_feature (9)..(14): 2'-O-methyl
  misc_feature (16)..(16): 2'-O-methyl
  misc_feature (1)..(19): ribonucleotide modified as described
  misc_feature (21)..(21): 3'-3 attached terminal deoxyabasic moeity
cugaguuuaaaaggcaccctt

SEQ ID NO: 2779 - DNA, 21 bp, Artificial Sequence
  Description of Artificial Sequence:  synthetic
  misc_feature (1)..(1): 5'-3 attached terminal deoxyabasic moeity
  misc_feature (4)..(4): 2'-O-methyl
  misc_feature (6)..(11): 2'-O-methyl
  misc_feature (15)..(17): 2'-O-methyl
  misc_feature (1)..(19): ribonucleotide modified as described
  misc_feature (21)..(21): 3'-3 attached terminal deoxyabasic moeity
cccacggaaaauuugaguctt

SEQ ID NO: 2780 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (5)..(5): 2'-deoxy-2'-fluoro
  misc_feature (12)..(14): 2'-deoxy-2'-fluoro
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cccacggaaaauuugaguctt

SEQ ID NO: 2781 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
gaacugaguuuaaaaggcatt

SEQ ID NO: 2782 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
aacugaguuuaaaaggcactt

SEQ ID NO: 2783 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acugaguuuaaaaggcacctt

SEQ ID NO: 2784 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ugaguuuaaaaggcacccatt

SEQ ID NO: 2785 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gaguuuaaaaggcacccagtt

SEQ ID NO: 2786 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
aguuuaaaaggcacccagctt

SEQ ID NO: 2787 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
guuuaaaaggcacccagcatt

SEQ ID NO: 2788 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugccuuuuaaacucaguuctt

SEQ ID NO: 2789 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gugccuuuuaaacucaguutt

SEQ ID NO: 2790 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ggugccuuuuaaacucagutt

SEQ ID NO: 2791 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugggugccuuuuaaacucatt

SEQ ID NO: 2792 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cugggugccuuuuaaacuctt

SEQ ID NO: 2793 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gcugggugccuuuuaaacutt

SEQ ID NO: 2794 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugcugggugccuuuuaaactt

SEQ ID NO: 2795 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acggaaaauuugagucaagtt

SEQ ID NO: 2796 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cacggaaaauuugagucaatt

SEQ ID NO: 2797 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ccacggaaaauuugagucatt

SEQ ID NO: 2798 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acccacggaaaauuugagutt

SEQ ID NO: 2799 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gacccacggaaaauuugagtt

SEQ ID NO: 2800 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cgacccacggaaaauuugatt

SEQ ID NO: 2801 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acgacccacggaaaauuugtt

SEQ ID NO: 2802 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cuugacucaaauuuuccgutt

SEQ ID NO: 2803 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uugacucaaauuuuccgugtt

SEQ ID NO: 2804 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugacucaaauuuuccguggtt

SEQ ID NO: 2805 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acucaaauuuuccgugggutt

SEQ ID NO: 2806 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cucaaauuuuccguggguctt

SEQ ID NO: 2807 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ucaaauuuuccgugggucgtt

SEQ ID NO: 2808 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
caaauuuuccgugggucgutt

SEQ ID NO: 2809 - RNA, 20 nt, Artificial Sequence
  Description of Artificial Sequence:  synthetic
  misc_feature (19)..(20): Phosphorothioate 3'-Internucleotide Linkage
  misc_feature (20)..(20): n is nitroindole universal base
gggugccuuuuaaacucagn

SEQ ID NO: 2810 - RNA, 28 nt, Artificial Sequence
  Description of Artificial Sequence:  synthetic
  misc_feature (1)..(1): 5'-3 attached terminal phosphate
  misc_feature (28)..(28): 3'-3 attached terminal deoxyabasic moeity
gggugccuuuuaaacucgaguuuaaaag

SEQ ID NO: 2811 - RNA, 30 nt, Artificial Sequence
  Description of Artificial Sequence:  synthetic
  misc_feature (1)..(1): 5'-3 attached terminal phosphate
  misc_feature (30)..(30): 3'-3 attached terminal deoxyabasic moeity
gggugccuuuuaaacucaggaguuuaaaag

SEQ ID NO: 2812 - RNA, 32 nt, Artificial Sequence
  Description of Artificial Sequence:  synthetic
  misc_feature (1)..(1): 5'-3 attached terminal phosphate
  misc_feature (32)..(32): 3'-3 attached terminal deoxyabasic moeity
caucagaggcccuccuugcaaggagggccucu

SEQ ID NO: 2813 - RNA, 31 nt, Artificial Sequence
  Description of Artificial Sequence:  synthetic
  misc_feature (1)..(1): 5'-3 attached terminal phosphate
  misc_feature (31)..(31): 3'-3 attached terminal deoxyabasic moeity
caucagaggcccuccuuaaggagggccucug

SEQ ID NO: 2814 - RNA, 29 nt, Artificial Sequence
  Description of Artificial Sequence:  synthetic
  misc_feature (1)..(1): 5'-3 attached terminal phosphate
  misc_feature (29)..(29): 3'-3 attached terminal deoxyabasic moeity
caucagaggcccuccuaggagggccucug

SEQ ID NO: 2815 - DNA, 21 bp, Artificial Sequence
  Description of Artificial Sequence:  synthetic
  misc_feature (1)..(1): 5'-3 attached terminal deoxyabasic moeity
  misc_feature (4)..(5): 2'-deoxy-2'-fluoro
  misc_feature (9)..(11): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
gaacugaguuuaaaaggcatt

SEQ ID NO: 2816 - DNA, 21 bp, Artificial Sequence
  Description of Artificial Sequence:  synthetic
  misc_feature (1)..(1): 5'-3 attached terminal deoxyabasic moeity
  misc_feature (3)..(4): 2'-deoxy-2'-fluoro
  misc_feature (8)..(10): 2'-deoxy-2'-fluoro
  misc_feature (17)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aacugaguuuaaaaggcactt

SEQ ID NO: 2817 - DNA, 21 bp, Artificial Sequence
  Description of Artificial Sequence:  synthetic
  misc_feature (1)..(1): 5'-3 attached terminal deoxyabasic moeity
  misc_feature (2)..(3): 2'-deoxy-2'-fluoro
  misc_feature (7)..(9): 2'-deoxy-2'-fluoro
  misc_feature (16)..(16): 2'-deoxy-2'-fluoro
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
acugaguuuaaaaggcacctt

SEQ ID NO: 2818 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (5)..(7): 2'-deoxy-2'-fluoro
  misc_feature (14)..(14): 2'-deoxy-2'-fluoro
  misc_feature (16)..(18): 2'-deoxy-2'-fluoro
  misc_feature (1)..(19): ribonucleotide modified as described
  misc_feature (21)..(21): 3'-3 attached terminal deoxyabasic moeity
ugaguuuaaaaggcacccatt

SEQ ID NO: 2819 - DNA, 21 bp, Artificial Sequence
  Description of Artificial Sequence:  synthetic
  misc_feature (1)..(1): 5'-3 attached terminal deoxyabasic moeity
  misc_feature (4)..(6): 2'-deoxy-2'-fluoro
  misc_feature (13)..(13): 2'-deoxy-2'-fluoro
  misc_feature (15)..(17): 2'-deoxy-2'-fluoro
  misc_feature (1)..(19): ribonucleotide modified as described
  misc_feature (21)..(21): 3'-3 attached terminal deoxyabasic moeity
gaguuuaaaaggcacccagtt

SEQ ID NO: 2820 - DNA, 21 bp, Artificial Sequence
  Description of Artificial Sequence:  synthetic
  misc_feature (1)..(1): 5'-3 attached terminal deoxyabasic moeity
  misc_feature (3)..(5): 2'-deoxy-2'-fluoro
  misc_feature (12)..(12): 2'-deoxy-2'-fluoro
  misc_feature (14)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aguuuaaaaggcacccagctt

SEQ ID NO: 2821 - DNA, 21 bp, Artificial Sequence
  Description of Artificial Sequence:  synthetic
  misc_feature (1)..(1): 5'-3 attached terminal deoxyabasic moeity
  misc_feature (2)..(4): 2'-deoxy-2'-fluoro
  misc_feature (11)..(11): 2'-deoxy-2'-fluoro
  misc_feature (13)..(15): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
guuuaaaaggcacccagcatt

SEQ ID NO: 2822 - DNA, 21 bp, Artificial Sequence
  Description of Artificial Sequence:  synthetic
  misc_feature (1)..(1): 2'-deoxy-2'-fluoro
  misc_feature (3)..(8): 2'-deoxy-2'-fluoro
  misc_feature (12)..(14): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
ugccuuuuaaacucaguuctt

SEQ ID NO: 2823 - DNA, 21 bp, Artificial Sequence
  Description of Artificial Sequence:  synthetic
  misc_feature (4)..(9): 2'-deoxy-2'-fluoro
  misc_feature (13)..(15): 2'-deoxy-2'-fluoro
  misc_feature (18)..(19): 2'-deoxy-2'-fluoro
  misc_feature (1)..(19): ribonucleotide modified as described
  misc_feature (20)..(20): Phosphorothioate 3'-Internucleotide Linkage
gugccuuuuaaacucaguutt

SEQ ID NO: 2824 - DNA, 21 bp, Artificial Sequence
  Description of Artificial Sequence:  synthetic
  misc_feature (3)..(3): 2'-deoxy-2'-fluoro
  misc_feature (5)..(10): 2'-deoxy-2'-fluoro
  misc_feature (14)..(16): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ggugccuuuuaaacucagutt

SEQ ID NO: 2825 - DNA, 21 bp, Artificial Sequence
  Description of Artificial Sequence:  synthetic
  misc_feature (1)..(1): 2'-deoxy-2'-fluoro
  misc_feature (5)..(5): 2'-deoxy-2'-fluoro
  misc_feature (7)..(12): 2'-deoxy-2'-fluoro
  misc_feature (16)..(18): 2'-deoxy-2'-fluoro
  misc_feature (1)..(19): ribonucleotide modified as described
  misc_feature (20)..(20): Phosphorothioate 3'-Internucleotide Linkage
ugggugccuuuuaaacucatt

SEQ ID NO: 2826 - DNA, 21 bp, Artificial Sequence
  Description of Artificial Sequence:  synthetic
  misc_feature (1)..(2): 2'-deoxy-2'-fluoro
  misc_feature (6)..(6): 2'-deoxy-2'-fluoro
  misc_feature (8)..(13): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
cugggugccuuuuaaacuctt

SEQ ID NO: 2827 - DNA, 21 bp, Artificial Sequence
  Description of Artificial Sequence:  synthetic
  misc_feature (2)..(3): 2'-deoxy-2'-fluoro
  misc_feature (7)..(7): 2'-deoxy-2'-fluoro
  misc_feature (9)..(14): 2'-deoxy-2'-fluoro
  misc_feature (18)..(19): 2'-deoxy-2'-fluoro
  misc_feature (1)..(19): ribonucleotide modified as described
  misc_feature (20)..(20): Phosphorothioate 3'-Internucleotide Linkage
gcugggugccuuuuaaacutt

SEQ ID NO: 2828 - DNA, 21 bp, Artificial Sequence
  Description of Artificial Sequence:  synthetic
  misc_feature (1)..(1): 2'-deoxy-2'-fluoro
  misc_feature (3)..(4): 2'-deoxy-2'-fluoro
  misc_feature (8)..(8): 2'-deoxy-2'-fluoro
  misc_feature (10)..(15): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ugcugggugccuuuuaaactt

SEQ ID NO: 2829 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (9)..(11): 2'-deoxy-2'-fluoro
  misc_feature (15)..(16): 2'-deoxy-2'-fluoro
  misc_feature (1)..(19): ribonucleotide modified as described
  misc_feature (21)..(21): 3'-3 attached terminal deoxyabasic moeity
acggaaaauuugagucaagtt

SEQ ID NO: 2830 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (3)..(3): 2'-deoxy-2'-fluoro
  misc_feature (10)..(12): 2'-deoxy-2'-fluoro
  misc_feature (16)..(17): 2'-deoxy-2'-fluoro
  misc_feature (1)..(19): ribonucleotide modified as described
  misc_feature (21)..(21): 3'-3 attached terminal deoxyabasic moeity
cacggaaaauuugagucaatt

SEQ ID NO: 2831 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (4)..(4): 2'-deoxy-2'-fluoro
  misc_feature (11)..(13): 2'-deoxy-2'-fluoro
  misc_feature (17)..(18): 2'-deoxy-2'-fluoro
  misc_feature (1)..(19): ribonucleotide modified as described
  misc_feature (21)..(21): 3'-3 attached terminal deoxyabasic moeity
ccacggaaaauuugagucatt

SEQ ID NO: 2832 - DNA, 21 bp, Artificial Sequence
  Description of Artificial Sequence:  synthetic
  misc_feature (1)..(1): 5'-3 attached terminal deoxyabasic moeity
  misc_feature (2)..(4): 2'-deoxy-2'-fluoro
  misc_feature (6)..(6): 2'-deoxy-2'-fluoro
  misc_feature (13)..(15): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
acccacggaaaauuugagutt

SEQ ID NO: 2833 - DNA, 21 bp, Artificial Sequence
  Description of Artificial Sequence:  synthetic
  misc_feature (1)..(1): 5'-3 attached terminal deoxyabasic moeity
  misc_feature (3)..(5): 2'-deoxy-2'-fluoro
  misc_feature (7)..(7): 2'-deoxy-2'-fluoro
  misc_feature (14)..(16): 2'-deoxy-2'-fluoro
  misc_feature (1)..(19): ribonucleotide modified as described
  misc_feature (21)..(21): 3'-3 attached terminal deoxyabasic moeity
gacccacggaaaauuugagtt

SEQ ID NO: 2834 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (4)..(6): 2'-deoxy-2'-fluoro
  misc_feature (8)..(8): 2'-deoxy-2'-fluoro
  misc_feature (15)..(17): 2'-deoxy-2'-fluoro
  misc_feature (1)..(19): ribonucleotide modified as described
  misc_feature (21)..(21): 3'-3 attached terminal deoxyabasic moeity
cgacccacggaaaauuugatt

SEQ ID NO: 2835 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (5)..(7): 2'-deoxy-2'-fluoro
  misc_feature (9)..(9): 2'-deoxy-2'-fluoro
  misc_feature (16)..(18): 2'-deoxy-2'-fluoro
  misc_feature (1)..(19): ribonucleotide modified as described
  misc_feature (21)..(21): 3'-3 attached terminal deoxyabasic moeity
acgacccacggaaaauuugtt

SEQ ID NO: 2836 - DNA, 21 bp, Artificial Sequence
  Description of Artificial Sequence:  synthetic
  misc_feature (1)..(3): 2'-deoxy-2'-fluoro
  misc_feature (6)..(8): 2'-deoxy-2'-fluoro
  misc_feature (12)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
cuugacucaaauuuuccgutt

SEQ ID NO: 2837 - DNA, 21 bp, Artificial Sequence
  Description of Artificial Sequence:  synthetic
  misc_feature (1)..(2): 2'-deoxy-2'-fluoro
  misc_feature (5)..(7): 2'-deoxy-2'-fluoro
  misc_feature (11)..(16): 2'-deoxy-2'-fluoro
  misc_feature (18)..(18): 2'-deoxy-2'-fluoro
  misc_feature (1)..(19): ribonucleotide modified as described
  misc_feature (20)..(20): Phosphorothioate 3'-Internucleotide Linkage
uugacucaaauuuuccgugtt

SEQ ID NO: 2838 - DNA, 21 bp, Artificial Sequence
  Description of Artificial Sequence:  synthetic
  misc_feature (1)..(1): 2'-deoxy-2'-fluoro
  misc_feature (4)..(6): 2'-deoxy-2'-fluoro
  misc_feature (10)..(15): 2'-deoxy-2'-fluoro
  misc_feature (17)..(17): 2'-deoxy-2'-fluoro
  misc_feature (20)..(20): 2'-deoxy-2'-fluoro
  misc_feature (1)..(19): ribonucleotide modified as described
ugacucaaauuuuccguggtt

SEQ ID NO: 2839 - DNA, 21 bp, Artificial Sequence
  Description of Artificial Sequence:  synthetic
  misc_feature (2)..(4): 2'-deoxy-2'-fluoro
  misc_feature (8)..(13): 2'-deoxy-2'-fluoro
  misc_feature (15)..(15): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
  misc_feature (20)..(19): 2'-deoxy-2'-fluoro
acucaaauuuuccgugggutt

SEQ ID NO: 2840 - DNA, 21 bp, Artificial Sequence
  Description of Artificial Sequence:  synthetic
  misc_feature (1)..(3): 2'-deoxy-2'-fluoro
  misc_feature (7)..(12): 2'-deoxy-2'-fluoro
  misc_feature (14)..(14): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
cucaaauuuuccguggguctt

SEQ ID NO: 2841 - DNA, 21 bp, Artificial Sequence
  Description of Artificial Sequence:  synthetic
  misc_feature (1)..(2): 2'-deoxy-2'-fluoro
  misc_feature (6)..(11): 2'-deoxy-2'-fluoro
  misc_feature (13)..(13): 2'-deoxy-2'-fluoro
  misc_feature (17)..(18): 2'-deoxy-2'-fluoro
  misc_feature (1)..(19): ribonucleotide modified as described
  misc_feature (1)..(19): ribonucleotide modified as described
  misc_feature (20)..(20): 2'-deoxy-2'-fluoro
ucaaauuuuccgugggucgtt

SEQ ID NO: 2842 - DNA, 21 bp, Artificial Sequence
  Description of Artificial Sequence:  synthetic
  misc_feature (1)..(1): 2'-deoxy-2'-fluoro
  misc_feature (5)..(10): 2'-deoxy-2'-fluoro
  misc_feature (12)..(12): 2'-deoxy-2'-fluoro
  misc_feature (16)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
caaauuuuccgugggucgutt

SEQ ID NO: 2843 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
cugaguuuaaaaggcaccctt

SEQ ID NO: 2844 - DNA, 21 bp, Artificial Sequence
  Description of Artificial Sequence:  synthetic
  misc_feature (1)..(1): 5'-3 attached terminal phosphate
  misc_feature (1)..(3): 2'-O-methyl
  misc_feature (5)..(5): 2'-O-methyl
  misc_feature (12)..(14): 2'-O-methyl
  misc_feature (18)..(19): 2'-O-methyl
  misc_feature (4)..(4): 2'-deoxy-2'-Fluoro
  misc_feature (6)..(11): 2'-deoxy-2'-Fluoro
  misc_feature (15)..(17): 2'-deoxy-2'-Fluoro
  misc_feature (20)..(20): Phosphorothioate 3'-Internucleotide Linkage
  misc_feature (1)..(19): ribonucleotide modified as described
gggugccuuuuaaacucagtt

SEQ ID NO: 2845 - DNA, 21 bp, Artificial Sequence
  Description of Artificial Sequence:  synthetic
  misc_feature (1)..(1): 5'-Amino Mod C3-TFA
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 2846 - DNA, 21 bp, Artificial Sequence
  Description of Artificial Sequence:  synthetic
  misc_feature (1)..(1): 5'-Amino Mod C3-TFA
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 2847 - DNA, 21 bp, Artificial Sequence
  Description of Artificial Sequence:  synthetic
  misc_feature (1)..(1): n stands for inosine
  misc_feature (1)..(19): ribonucleotide modified as described
nggugccuuuuaaacucagtt

SEQ ID NO: 2848 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (7)..(9): 2'-deoxy
  misc_feature (10)..(11): 2'-deoxy-2'-fluoro
  misc_feature (12)..(12): 2'-deoxy
  misc_feature (13)..(14): 2'-deoxy-2'-fluoro
  misc_feature (15)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
caugcuggacugcuggcactt

SEQ ID NO: 2849 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(8): 2'-deoxy
  misc_feature (9)..(10): 2'-deoxy-2'-fluoro
  misc_feature (11)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
augcuggacugcuggcacatt

SEQ ID NO: 2850 - DNA, 21 bp, Artificial Sequence
  Description of Artificial Sequence:  synthetic
  misc_feature (1)..(1): 2'-O-methyl
  misc_feature (2)..(2): 2'-deoxy-2'-Fluoro
  misc_feature (3)..(3): 2'-O-methyl
  misc_feature (4)..(5): 2'-deoxy-2'-Fluoro
  misc_feature (6)..(7): 2'-O-methyl
  misc_feature (8)..(8): 2'-deoxy-2'-Fluoro
  misc_feature (9)..(10): 2'-O-methyl
  misc_feature (11)..(13): 2'-deoxy-2'-Fluoro
  misc_feature (14)..(15): 2'-O-methyl
  misc_feature (16)..(16): 2'-deoxy-2'-Fluoro
  misc_feature (17)..(17): 2'-O-methyl
  misc_feature (18)..(18): 2'-deoxy-2'-Fluoro
  misc_feature (19)..(19): 2'-O-methyl
  misc_feature (1)..(19): ribonucleotide modified as described
  misc_feature (20)..(20): Phosphorothioate 3'-Internucleotide Linkage
gugccagcaguccagcaugtt

SEQ ID NO: 2851 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (5)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
ugugccagcaguccagcautt

SEQ ID NO: 2852 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
caugcuggacugcuggcactt

SEQ ID NO: 2853 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
augcuggacugcuggcacatt

SEQ ID NO: 2854 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gugccagcaguccagcaugtt

SEQ ID NO: 2855 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugugccagcaguccagcautt

SEQ ID NO: 2856 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cacggucgucaggucguactt

SEQ ID NO: 2857 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(8): 2'-deoxy-2'-fluoro
  misc_feature (9)..(9): 2'-deoxy
  misc_feature (10)..(11): 2'-deoxy-2'-fluoro
  misc_feature (12)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
acacggucgucaggucguatt

SEQ ID NO: 2858 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(3): 2'-O-methyl
  misc_feature (4)..(4): 2'-deoxy-2'-fluoro
  misc_feature (5)..(6): 2'-O-methyl
  misc_feature (7)..(9): 2'-deoxy-2'-fluoro
  misc_feature (10)..(11): 2'-O-methyl
  misc_feature (12)..(12): 2'-deoxy-2'-fluoro
  misc_feature (13)..(14): 2'-O-methyl
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
guacgaccugacgaccgugtt

SEQ ID NO: 2859 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(5): 2'-O-methyl
  misc_feature (6)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (20)..(21): L-thymidine
uacgaccugacgaccgugutt

SEQ ID NO: 2860 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cacggucgucaggucguactt

SEQ ID NO: 2861 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acacggucgucaggucguatt

SEQ ID NO: 2862 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
guacgaccugacgaccgugtt

SEQ ID NO: 2863 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uacgaccugacgaccgugutt

SEQ ID NO: 2864 - DNA, 21 bp, Artificial Sequence
  Description of Artificial Sequence:  synthetic
  misc_feature (1)..(1): 5'-3 attached terminal deoxyabasic moeity
  misc_feature (1)..(2): Phosphorothioate 3'-Internucleotide Linkage
  misc_feature (8)..(12): Phosphorothioate 3'-Internucleotide Linkage
  misc_feature (18)..(20): Phosphorothioate 3'-Internucleotide Linkage
  misc_feature (1)..(19): ribonucleotide modified as described
  misc_feature (21)..(21): 3'-3 attached terminal deoxyabasic moeity
cugaguuuaaaaggcaccctt

SEQ ID NO: 2865 - DNA, 21 bp, Artificial Sequence
  Description of Artificial Sequence:  synthetic
  misc_feature (3)..(7): Phosphorothioate 3'-Internucleotide Linkage
  misc_feature (13)..(17): Phosphorothioate 3'-Internucleotide Linkage
  misc_feature (1)..(19): ribonucleotide modified as described
  misc_feature (20)..(21): Phosphorothioate 3'-Internucleotide Linkage
gggugccuuuuaaacucagtt

SEQ ID NO: 2866 - DNA, 21 bp, Artificial Sequence
  Description of Artificial Sequence:  synthetic
  misc_feature (1)..(2): Phosphorothioate 3'-Internucleotide Linkage
  misc_feature (1)..(1): 5'-3 attached terminal deoxyabasic moeity
  misc_feature (8)..(12): Phosphorothioate 3'-Internucleotide Linkage
  misc_feature (18)..(20): Phosphorothioate 3'-Internucleotide Linkage
  misc_feature (1)..(19): ribonucleotide modified as described
  misc_feature (21)..(21): 3'-3 attached terminal deoxyabasic moeity
cccacggaaaauuugaguctt

SEQ ID NO: 2867 - DNA, 21 bp, Artificial Sequence
  Description of Artificial Sequence:  synthetic
  misc_feature (3)..(7): Phosphorothioate 3'-Internucleotide Linkage
  misc_feature (13)..(17): Phosphorothioate 3'-Internucleotide Linkage
  misc_feature (1)..(19): ribonucleotide modified as described
  misc_feature (20)..(20): Phosphorothioate 3'-Internucleotide Linkage
gacucaaauuuuccgugggtt

SEQ ID NO: 2868 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
cugaguuuaaaaggcaccctt

SEQ ID NO: 2869 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
caaccacaaaauacaacaatt

SEQ ID NO: 2870 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
ccuggaaagaaucaaaacctt

SEQ ID NO: 2871 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
gcaaggagggccucugaugtt

SEQ ID NO: 2872 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
gggugccuuuuaaacucagtt

SEQ ID NO: 2873 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
uuguuguauuuugugguugtt

SEQ ID NO: 2874 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
gguuuugauucuuuccaggtt

SEQ ID NO: 2875 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
caucagaggcccuccuugctt

SEQ ID NO: 2876 - DNA, 21 bp, Artificial Sequence
  Description of Artificial Sequence:  synthetic
  misc_feature (1)..(4): Phosphorothioate 3'-Internucleotide Linkage
  misc_feature (1)..(2): 2'-deoxy-2'-fluoro
  misc_feature (6)..(8): 2'-deoxy-2'-fluoro
  misc_feature (15)..(15): 2'-deoxy-2'-fluoro
  misc_feature (17)..(19): 2'-deoxy-2'-fluoro
  misc_feature (17)..(20): Phosphorothioate 3'-Internucleotide Linkage
  misc_feature (1)..(19): ribonucleotide modified as described
cugaguuuaaaaggcaccctt

SEQ ID NO: 2877 - DNA, 21 bp, Artificial Sequence
  Description of Artificial Sequence:  synthetic
  misc_feature (1)..(4): Phosphorothioate 3'-Internucleotide Linkage
  misc_feature (1)..(1): 2'-deoxy-2'-fluoro
  misc_feature (4)..(5): 2'-deoxy-2'-fluoro
  misc_feature (7)..(7): 2'-deoxy-2'-fluoro
  misc_feature (12)..(12): 2'-deoxy-2'-fluoro
  misc_feature (14)..(14): 2'-deoxy-2'-fluoro
  misc_feature (17)..(17): 2'-deoxy-2'-fluoro
  misc_feature (17)..(20): Phosphorothioate 3'-Internucleotide Linkage
  misc_feature (1)..(19): ribonucleotide modified as described
caaccacaaaauacaacaatt

SEQ ID NO: 2878 - DNA, 21 bp, Artificial Sequence
  Description of Artificial Sequence:  synthetic
  misc_feature (1)..(4): Phosphorothioate 3'-Internucleotide Linkage
  misc_feature (1)..(3): 2'-deoxy-2'-fluoro
  misc_feature (12)..(13): 2'-deoxy-2'-fluoro
  misc_feature (17)..(20): Phosphorothioate 3'-Internucleotide Linkage
  misc_feature (18)..(19): 2'-deoxy-2'-fluoro
  misc_feature (1)..(19): ribonucleotide modified as described
ccuggaaagaaucaaaacctt

SEQ ID NO: 2879 - DNA, 21 bp, Artificial Sequence
  Description of Artificial Sequence:  synthetic
  misc_feature (1)..(4): Phosphorothioate 3'-Internucleotide Linkage
  misc_feature (2)..(2): 2'-deoxy-2'-fluoro
  misc_feature (11)..(15): 2'-deoxy-2'-fluoro
  misc_feature (17)..(20): Phosphorothioate 3'-Internucleotide Linkage
  misc_feature (18)..(18): 2'-deoxy-2'-fluoro
  misc_feature (1)..(19): ribonucleotide modified as described
gcaaggagggccucugaugtt

SEQ ID NO: 2880 - DNA, 21 bp, Artificial Sequence
  Description of Artificial Sequence:  synthetic
  misc_feature (1)..(20): Phosphorothioate 3'-Internucleotide Linkage
  misc_feature (1)..(19): ribonucleotide modified as described
gggugccuuuuaaacucagtt

SEQ ID NO: 2881 - DNA, 21 bp, Artificial Sequence
  Description of Artificial Sequence:  synthetic
  misc_feature (1)..(20): Phosphorothioate 3'-Internucleotide Linkage
  misc_feature (1)..(19): ribonucleotide modified as described
uuguuguauuuugugguugtt

SEQ ID NO: 2882 - DNA, 21 bp, Artificial Sequence
  Description of Artificial Sequence:  synthetic
  misc_feature (1)..(20): Phosphorothioate 3'-Internucleotide Linkage
  misc_feature (1)..(19): ribonucleotide modified as described
gguuuugauucuuuccaggtt

SEQ ID NO: 2883 - DNA, 21 bp, Artificial Sequence
  Description of Artificial Sequence:  synthetic
  misc_feature (1)..(20): Phosphorothioate 3'-Internucleotide Linkage
  misc_feature (1)..(19): ribonucleotide modified as described
caucagaggcccuccuugctt

SEQ ID NO: 2884 - DNA, 21 bp, Artificial Sequence
  Description of Artificial Sequence:  synthetic
caaccacaaaauacaacaaga

SEQ ID NO: 2885 - DNA, 21 bp, Artificial Sequence
  Description of Artificial Sequence:  synthetic
uuguuguauuuugugguuguu

SEQ ID NO: 2886 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
aacaacauaaaacaccaactt

SEQ ID NO: 2887 - DNA, 21 bp, Artificial Sequence
  Description of Artificial Sequence:  synthetic
  misc_feature (1)..(5): Phosphorothioate 3'-Internucleotide Linkage
  misc_feature (20)..(20): Phosphorothioate 3'-Internucleotide Linkage
  misc_feature (1)..(19): ribonucleotide modified as described
guugguguuuuauguuguutt

SEQ ID NO: 2888 - DNA, 21 bp, Artificial Sequence
  Description of Artificial Sequence:  synthetic
  misc_feature (1)..(4): Phosphorothioate 3'-Internucleotide Linkage
  misc_feature (3)..(3): 2'-deoxy-2'-fluoro
  misc_feature (6)..(6): 2'-deoxy-2'-fluoro
  misc_feature (8)..(8): 2'-deoxy-2'-fluoro
  misc_feature (13)..(13): 2'-deoxy-2'-fluoro
  misc_feature (15)..(16): 2'-deoxy-2'-fluoro
  misc_feature (17)..(20): Phosphorothioate 3'-Internucleotide Linkage
  misc_feature (19)..(19): 2'-deoxy-2'-fluoro
  misc_feature (1)..(19): ribonucleotide modified as described
aacaacauaaaacaccaactt

SEQ ID NO: 2889 - DNA, 21 bp, Artificial Sequence
  Description of Artificial Sequence:  synthetic
  misc_feature (1)..(20): Phosphorothioate 3'-Internucleotide Linkage
  misc_feature (1)..(19): ribonucleotide modified as described
guugguguuuuauguuguutt

SEQ ID NO: 2890 - DNA, 21 bp, Artificial Sequence
  Description of Artificial Sequence:  synthetic
agaacaacauaaaacaccaac

SEQ ID NO: 2891 - DNA, 21 bp, Artificial Sequence
  Description of Artificial Sequence:  synthetic
uuguugguguuuuauguuguu

SEQ ID NO: 2892 - DNA, 21 bp, Artificial Sequence
  Description of Artificial Sequence:  synthetic
  misc_feature (1)..(19): ribonucleotide modified as described
caaccacaaaauacaacaatt

SEQ ID NO: 2893 - DNA, 21 bp, Artificial Sequence
  Description of Artificial Sequence:  synthetic
  misc_feature (1)..(19): ribonucleotide modified as described
uuguuguauuuugugguugtt

SEQ ID NO: 2894 - DNA, 21 bp, Artificial Sequence
  Description of Artificial Sequence:  synthetic
  misc_feature (1)..(19): ribonucleotide modified as described
agaacaacauaaaacaccatt

SEQ ID NO: 2895 - DNA, 21 bp, Artificial Sequence
  Description of Artificial Sequence:  synthetic
  misc_feature (1)..(19): ribonucleotide modified as described
uuguugguguuuuauguugtt

SEQ ID NO: 2896 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
uuguuguauuuugugguugtt

SEQ ID NO: 2897 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (20)..(21): nitroindole
uuguuguauuuugugguugtt

SEQ ID NO: 2898 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (20)..(21): nitropyrrole
uuguuguauuuugugguugtt

SEQ ID NO: 2899 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (4)..(5): 2'-deoxy-2'-fluoro
  misc_feature (7)..(7): 2'-deoxy-2'-fluoro
  misc_feature (12)..(12): 2'-deoxy-2'-fluoro
  misc_feature (14)..(14): 2'-deoxy-2'-fluoro
  misc_feature (17)..(17): 2'-deoxy-2'-fluoro
  misc_feature (1)..(19): ribonucleotide modified as described
  misc_feature (21)..(21): 3'-3 attached terminal deoxyabasic moeity
caaccacaaaauacaacaatt

SEQ ID NO: 2900 - DNA, 21 bp, Artificial Sequence
  Description of Artificial Sequence:  synthetic
  misc_feature (1)..(1): 2'-deoxy-2'-fluoro
  misc_feature (4)..(5): 2'-deoxy-2'-fluoro
  misc_feature (7)..(7): 2'-deoxy-2'-fluoro
  misc_feature (12)..(12): 2'-deoxy-2'-fluoro
  misc_feature (14)..(14): 2'-deoxy-2'-fluoro
  misc_feature (17)..(17): 2'-deoxy-2'-fluoro
  misc_feature (1)..(19): ribonucleotide modified as described
caaccacaaaauacaacaatt

SEQ ID NO: 2901 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
  misc_feature (21)..(21): 3'-deoxy T
uuguuguauuuugugguugtt

SEQ ID NO: 2902 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
  misc_feature (21)..(21): attached glyceryl moiety
uuguuguauuuugugguugtt

SEQ ID NO: 2903 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
  misc_feature (21)..(21): 3'-O-Methyl Uridine
uuguuguauuuugugguugnu

SEQ ID NO: 2904 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
  misc_feature (21)..(21): L-thymidine
uuguuguauuuugugguugtt

SEQ ID NO: 2905 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
  misc_feature (21)..(21): L uridine
uuguuguauuuugugguugnu

SEQ ID NO: 2906 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (1)..(19): ribonucleotide modified as described
  misc_feature (21)..(21): inverted thymidine
uuguuguauuuugugguugtt

SEQ ID NO: 2907 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (20)..(20): 3'-deoxy T
  misc_feature (1)..(19): ribonucleotide modified as described
uuguuguauuuugugguugtt

SEQ ID NO: 2908 - DNA, 21 bp, Artificial Sequence
  Description of Artificial Sequence:  synthetic
  misc_feature (1)..(2): 2'-deoxy-2'-fluoro
  misc_feature (4)..(5): 2'-deoxy-2'-fluoro
  misc_feature (7)..(7): 2'-deoxy-2'-fluoro
  misc_feature (9)..(12): 2'-deoxy-2'-fluoro
  misc_feature (14)..(14): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (1)..(19): ribonucleotide modified as described
uuguuguauuuugugguugtt

SEQ ID NO: 2909 - DNA, 21 bp, Artificial Sequence
  Description of Artificial Sequence:  synthetic
  misc_feature (1)..(1): 5'-3 attached terminal deoxyabasic moeity
  misc_feature (2)..(2): Phosphorothioate 3'-Internucleotide Linkage
  misc_feature (4)..(4): Phosphorothioate 3'-Internucleotide Linkage
  misc_feature (11)..(11): Phosphorothioate 3'-Internucleotide Linkage
  misc_feature (15)..(16): Phosphorothioate 3'-Internucleotide Linkage
  misc_feature (18)..(19): Phosphorothioate 3'-Internucleotide Linkage
  misc_feature (1)..(19): ribonucleotide modified as described
  misc_feature (21)..(21): 3'-3 attached terminal deoxyabasic moeity
guguaaggaguggaccauctt

SEQ ID NO: 2910 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (7)..(7): 2'-deoxy-2'-fluoro
  misc_feature (9)..(10): 2'-deoxy-2'-fluoro
  misc_feature (12)..(13): 2'-deoxy-2'-fluoro
  misc_feature (15)..(15): 2'-deoxy-2'-fluoro
  misc_feature (1)..(19): ribonucleotide modified as described
  misc_feature (21)..(21): 3'-3 attached terminal deoxyabasic moeity
acggaguauugcugugggatt

SEQ ID NO: 2911 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (6)..(8): 2'-deoxy-2'-fluoro
  misc_feature (13)..(13): 2'-deoxy-2'-fluoro
  misc_feature (15)..(15): 2'-deoxy-2'-fluoro
  misc_feature (17)..(17): 2'-deoxy-2'-fluoro
  misc_feature (1)..(19): ribonucleotide modified as described
  misc_feature (21)..(21): 3'-3 attached terminal deoxyabasic moeity
gcaggccuaagacaugugatt

SEQ ID NO: 2912 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (8)..(8): 2'-deoxy-2'-fluoro
  misc_feature (1)..(19): ribonucleotide modified as described
  misc_feature (21)..(21): 3'-3 attached terminal deoxyabasic moeity
caaaaagcaagggagaaaatt

SEQ ID NO: 2913 - DNA, 21 bp, Artificial Sequence
  Description of Artificial Sequence:  synthetic
  misc_feature (3)..(3): 2'-deoxy-2'-fluoro
  misc_feature (6)..(8): 2'-deoxy-2'-fluoro
  misc_feature (10)..(15): 2'-deoxy-2'-fluoro
  misc_feature (17)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gaugguccacuccuuacactt

SEQ ID NO: 2914 - DNA, 21 bp, Artificial Sequence
  Description of Artificial Sequence:  synthetic
  misc_feature (1)..(4): 2'-deoxy-2'-fluoro
  misc_feature (6)..(6): 2'-deoxy-2'-fluoro
  misc_feature (9)..(9): 2'-deoxy-2'-fluoro
  misc_feature (12)..(12): 2'-deoxy-2'-fluoro
  misc_feature (14)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ucccacagcaauacuccgutt

SEQ ID NO: 2915 - DNA, 21 bp, Artificial Sequence
  Description of Artificial Sequence:  synthetic
  misc_feature (1)..(2): 2'-deoxy-2'-fluoro
  misc_feature (4)..(4): 2'-deoxy-2'-fluoro
  misc_feature (6)..(6): 2'-deoxy-2'-fluoro
  misc_feature (8)..(11): 2'-deoxy-2'-fluoro
  misc_feature (15)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ucacaugucuuaggccugctt

SEQ ID NO: 2916 - DNA, 21 bp, Artificial Sequence
  Description of Artificial Sequence:  synthetic
  misc_feature (1)..(11): 2'-deoxy-2'-fluoro
  misc_feature (13)..(18): 2'-deoxy-2'-fluoro
  misc_feature (20)..(20): Phosphorothioate 3'-Internucleotide Linkage
  misc_feature (1)..(19): ribonucleotide modified as described
uuuucucccuugcuuuuugtt

SEQ ID NO: 2917 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(3): 2'-deoxy
  misc_feature (4)..(5): 2'-deoxy-2'-fluoro
  misc_feature (6)..(6): 2'-deoxy
  misc_feature (7)..(7): 2'-deoxy-2'-fluoro
  misc_feature (8)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
caaccacaaaauacaacaatt

SEQ ID NO: 2918 - DNA, 21 bp, Artificial Sequence
  Description of Artificial Sequence:  synthetic
  misc_feature (1)..(2): 2'-deoxy-2'-fluoro
  misc_feature (3)..(3): 2'-O-methyl
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
uuguuguauuuugugguugtt

SEQ ID NO: 2919 - DNA, 21 bp, Artificial Sequence
  Description of Artificial Sequence:  synthetic
  misc_feature (1)..(19): ribonucleotide modified as described
aacaacauaaaacaccaactt

SEQ ID NO: 2920 - DNA, 21 bp, Artificial Sequence
  Description of Artificial Sequence:  synthetic
  misc_feature (1)..(19): ribonucleotide modified as described
guugguguuuuauguuguutt

SEQ ID NO: 2921 - DNA, 21 bp, Artificial Sequence
  Description of Artificial Sequence:  synthetic
  misc_feature (1)..(1): 5'-3 attached terminal deoxyabasic moeity
  misc_feature (3)..(3): 2'-deoxy-2'-fluoro
  misc_feature (6)..(6): 2'-deoxy-2'-fluoro
  misc_feature (8)..(8): 2'-deoxy-2'-fluoro
  misc_feature (13)..(13): 2'-deoxy-2'-fluoro
  misc_feature (15)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aacaacauaaaacaccaactt

SEQ ID NO: 2922 - DNA, 21 bp, Artificial Sequence
  Description of Artificial Sequence:  synthetic
  misc_feature (2)..(3): 2'-deoxy-2'-fluoro
  misc_feature (6)..(6): 2'-deoxy-2'-fluoro
  misc_feature (8)..(11): 2'-deoxy-2'-fluoro
  misc_feature (13)..(13): 2'-deoxy-2'-fluoro
  misc_feature (15)..(16): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
guugguguuuuauguuguutt

SEQ ID NO: 2923 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aacaacauaaaacaccaactt

SEQ ID NO: 2924 - DNA, 21 bp, Artificial Sequence
  Description of Artificial Sequence:  synthetic
  misc_feature (2)..(3): 2'-deoxy-2'-fluoro
  misc_feature (6)..(6): 2'-deoxy-2'-fluoro
  misc_feature (8)..(11): 2'-deoxy-2'-fluoro
  misc_feature (13)..(13): 2'-deoxy-2'-fluoro
  misc_feature (15)..(16): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
guugguguuuuauguuguutt

SEQ ID NO: 2925 - DNA, 21 bp, Artificial Sequence
  Description of Artificial Sequence:  synthetic
  misc_feature (1)..(19): ribonucleotide modified as described
cugaguuuaaaaggcaccctt

SEQ ID NO: 2926 - DNA, 21 bp, Artificial Sequence
  Description of Artificial Sequence:  synthetic
  misc_feature (1)..(19): ribonucleotide modified as described
gcaaggagggccucugaugtt

SEQ ID NO: 2927 - DNA, 21 bp, Artificial Sequence
  Description of Artificial Sequence:  synthetic
  misc_feature (1)..(19): ribonucleotide modified as described
ccuggaaagaaucaaaacctt

SEQ ID NO: 2928 - DNA, 21 bp, Artificial Sequence
  Description of Artificial Sequence:  synthetic
  misc_feature (1)..(19): ribonucleotide modified as described
gggugccuuuuaaacucagtt

SEQ ID NO: 2929 - DNA, 21 bp, Artificial Sequence
  Description of Artificial Sequence:  synthetic
  misc_feature (1)..(19): ribonucleotide modified as described
caucagaggcccuccuugctt

SEQ ID NO: 2930 - DNA, 21 bp, Artificial Sequence
  Description of Artificial Sequence:  synthetic
  misc_feature (1)..(19): ribonucleotide modified as described
gguuuugauucuuuccaggtt

SEQ ID NO: 2931 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (6)..(8): 2'-deoxy-2'-fluoro
  misc_feature (15)..(15): 2'-deoxy-2'-fluoro
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
cugaguuuaaaaggcaccctt

SEQ ID NO: 2932 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (11)..(15): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
gcaaggagggccucugaugtt

SEQ ID NO: 2933 - DNA, 21 bp, Artificial Sequence
  Description of Artificial Sequence:  synthetic
  misc_feature (1)..(3): 2'-deoxy-2'-fluoro
  misc_feature (1)..(1): 5'-3 attached terminal deoxyabasic moeity
  misc_feature (12)..(13): 2'-deoxy-2'-fluoro
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
ccuggaaagaaucaaaacctt

SEQ ID NO: 2934 - DNA, 21 bp, Artificial Sequence
  Description of Artificial Sequence:  synthetic
  misc_feature (4)..(4): 2'-deoxy-2'-fluoro
  misc_feature (6)..(11): 2'-deoxy-2'-fluoro
  misc_feature (15)..(17): 2'-deoxy-2'-fluoro
  misc_feature (20)..(20): Phosphorothioate 3'-Internucleotide Linkage
  misc_feature (1)..(19): ribonucleotide modified as described
gggugccuuuuaaacucagtt

SEQ ID NO: 2935 - DNA, 21 bp, Artificial Sequence
  Description of Artificial Sequence:  synthetic
  misc_feature (1)..(1): 2'-deoxy-2'-fluoro
  misc_feature (3)..(4): 2'-deoxy-2'-fluoro
  misc_feature (10)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
caucagaggcccuccuugctt

SEQ ID NO: 2936 - DNA, 21 bp, Artificial Sequence
  Description of Artificial Sequence:  synthetic
  misc_feature (3)..(6): 2'-deoxy-2'-fluoro
  misc_feature (9)..(16): 2'-deoxy-2'-fluoro
  misc_feature (20)..(20): Phosphorothioate 3'-Internucleotide Linkage
  misc_feature (1)..(19): ribonucleotide modified as described
gguuuugauucuuuccaggtt

SEQ ID NO: 2937 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(5): 2'-deoxy
  misc_feature (6)..(8): 2'-deoxy-2'-fluoro
  misc_feature (9)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
cugaguuuaaaaggcaccctt

SEQ ID NO: 2938 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(10): 2'-deoxy
  misc_feature (11)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
gcaaggagggccucugaugtt

SEQ ID NO: 2939 - DNA, 21 bp, Artificial Sequence
  Description of Artificial Sequence:  synthetic
  misc_feature (1)..(3): 2'-deoxy-2'-fluoro
  misc_feature (1)..(1): 5'-3 attached terminal deoxyabasic moeity
  misc_feature (4)..(11): 2'-deoxy
  misc_feature (12)..(13): 2'-deoxy-2'-fluoro
  misc_feature (14)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
ccuggaaagaaucaaaacctt

SEQ ID NO: 2940 - DNA, 21 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 2941 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(9): 2'-O-methyl
  misc_feature (10)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
caucagaggcccuccuugctt

SEQ ID NO: 2942 - DNA, 21 bp, Artificial Sequence
  Description of Artificial Sequence:  synthetic
  misc_feature (1)..(2): 2'-O-methyl
  misc_feature (3)..(6): 2'-deoxy-2'-fluoro
  misc_feature (7)..(8): 2'-O-methyl
  misc_feature (9)..(16): 2'-deoxy-2'-fluoro
  misc_feature (17)..(19): 2'-O-methyl
  misc_feature (20)..(20): Phosphorothioate 3'-Internucleotide Linkage
  misc_feature (1)..(19): ribonucleotide modified as described
gguuuugauucuuuccaggtt

SEQ ID NO: 2943 - DNA, 21 bp, Artificial Sequence
  Description of Artificial Sequence:  synthetic
  misc_feature (1)..(19): ribonucleotide modified as described
cccacggaaaauuugaguctt

SEQ ID NO: 2944 - DNA, 21 bp, Artificial Sequence
  Description of Artificial Sequence:  synthetic
  misc_feature (1)..(19): ribonucleotide modified as described
guagucuccgggaggaacgtt

SEQ ID NO: 2945 - DNA, 21 bp, Artificial Sequence
  Description of Artificial Sequence:  synthetic
  misc_feature (1)..(19): ribonucleotide modified as described
ccaaaacuaagaaaggucctt

SEQ ID NO: 2946 - DNA, 21 bp, Artificial Sequence
  Description of Artificial Sequence:  synthetic
  misc_feature (1)..(19): ribonucleotide modified as described
gacucaaauuuuccgugggtt

SEQ ID NO: 2947 - DNA, 21 bp, Artificial Sequence
  Description of Artificial Sequence:  synthetic
  misc_feature (1)..(19): ribonucleotide modified as described
cguuccucccggagacuactt

SEQ ID NO: 2948 - DNA, 21 bp, Artificial Sequence
  Description of Artificial Sequence:  synthetic
  misc_feature (1)..(19): ribonucleotide modified as described
ggaccuuucuuaguuuuggtt

SEQ ID NO: 2949 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (5)..(5): 2'-deoxy-2'-fluoro
  misc_feature (12)..(14): 2'-deoxy-2'-fluoro
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cccacggaaaauuugaguctt

SEQ ID NO: 2950 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (5)..(9): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
guagucuccgggaggaacgtt

SEQ ID NO: 2951 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (7)..(8): 2'-deoxy-2'-fluoro
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
ccaaaacuaagaaaggucctt

SEQ ID NO: 2952 - DNA, 21 bp, Artificial Sequence
  Description of Artificial Sequence:  synthetic
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(9): 2'-deoxy
  misc_feature (10)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
caucagaggcccuccuugctt

SEQ ID NO: 2953 - DNA, 21 bp, Artificial Sequence
  Description of Artificial Sequence:  synthetic
  misc_feature (1)..(3): 2'-deoxy
  misc_feature (4)..(4): 2'-deoxy-2'-fluoro
  misc_feature (5)..(5): 2'-deoxy
  misc_feature (6)..(11): 2'-deoxy-2'-fluoro
  misc_feature (12)..(14): 2'-deoxy
  misc_feature (15)..(17): 2'-deoxy-2'-fluoro
  misc_feature (18)..(19): 2'-deoxy
  misc_feature (20)..(20): Phosphorothioate 3'-Internucleotide Linkage
  misc_feature (1)..(19): ribonucleotide modified as described
gggugccuuuuaaacucagtt

SEQ ID NO: 2954 - DNA, 21 bp, Artificial Sequence
  Description of Artificial Sequence:  synthetic
  misc_feature (1)..(2): 2'-deoxy
  misc_feature (3)..(6): 2'-deoxy-2'-fluoro
  misc_feature (7)..(8): 2'-deoxy
  misc_feature (9)..(16): 2'-deoxy-2'-fluoro
  misc_feature (17)..(19): 2'-deoxy
  misc_feature (20)..(20): Phosphorothioate 3'-Internucleotide Linkage
  misc_feature (1)..(19): ribonucleotide modified as described
gguuuugauucuuuccaggtt

SEQ ID NO: 2955 - DNA, 21 bp, Artificial Sequence
  Description of Artificial Sequence:  synthetic
  misc_feature (1)..(1): 2'-deoxy
  misc_feature (2)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
guugguguuuuauguuguutt

SEQ ID NO: 2956 - DNA, 21 bp, Artificial Sequence
  Description of Artificial Sequence:  synthetic
  misc_feature (1)..(1): 2'-deoxy-2'-fluoro
  misc_feature (2)..(2): 2'-deoxy
  misc_feature (3)..(10): 2'-deoxy-2'-fluoro
  misc_feature (11)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
cguuccucccggagacuactt

SEQ ID NO: 2957 - DNA, 21 bp, Artificial Sequence
  Description of Artificial Sequence:  synthetic
  misc_feature (1)..(2): 2'-deoxy
  misc_feature (3)..(5): 2'-deoxy-2'-fluoro
  misc_feature (6)..(8): 2'-deoxy
  misc_feature (9)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (20)..(20): Phosphorothioate 3'-Internucleotide Linkage
  misc_feature (1)..(19): ribonucleotide modified as described
gacucaaauuuuccgugggtt

SEQ ID NO: 2958 - DNA, 21 bp, Artificial Sequence
  Description of Artificial Sequence:  synthetic
  misc_feature (1)..(3): 2'-deoxy
  misc_feature (4)..(11): 2'-deoxy-2'-fluoro
  misc_feature (12)..(13): 2'-deoxy
  misc_feature (14)..(17): 2'-deoxy-2'-fluoro
  misc_feature (18)..(19): 2'-deoxy
  misc_feature (20)..(20): Phosphorothioate 3'-Internucleotide Linkage
  misc_feature (1)..(19): ribonucleotide modified as described
ggaccuuucuuaguuuuggtt

SEQ ID NO: 2959 - DNA, 20 bp, Artificial Sequence
  Description of Artificial Sequence:  synthetic
  misc_feature (1)..(18): ribonucleotide
  misc_feature (20)..(20): 3'-3 attached terminal deoxyabasic moeity
ugaguuuaaaaggcaccctt

SEQ ID NO: 2960 - DNA, 19 bp, Artificial Sequence
  Description of Artificial Sequence:  synthetic
  misc_feature (1)..(17): ribonucleotide
  misc_feature (19)..(19): 3'-3 attached terminal deoxyabasic moeity
gaguuuaaaaggcaccctt

SEQ ID NO: 2961 - DNA, 18 bp, Artificial Sequence
  Description of Artificial Sequence:  synthetic
  misc_feature (1)..(16): ribonucleotide
  misc_feature (18)..(18): 3'-3 attached terminal deoxyabasic moeity
aguuuaaaaggcaccctt

SEQ ID NO: 2962 - DNA, 17 bp, Artificial Sequence
  Description of Artificial Sequence:  synthetic
  misc_feature (1)..(15): ribonucleotide
  misc_feature (17)..(17): 3'-3 attached terminal deoxyabasic moeity
guuuaaaaggcaccctt

SEQ ID NO: 2963 - DNA, 15 bp, Artificial Sequence
  Description of Artificial Sequence:  synthetic
  misc_feature (1)..(13): ribonucleotide
  misc_feature (15)..(15): 3'-3 attached terminal deoxyabasic moeity
uuaaaaggcaccctt

SEQ ID NO: 2964 - DNA, 13 bp, Artificial Sequence
  Description of Artificial Sequence:  synthetic
  misc_feature (1)..(11): ribonucleotide
  misc_feature (13)..(13): 3'-3 attached terminal deoxyabasic moeity
aaaaggcaccctt

SEQ ID NO: 2965 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
cugaguuuaaaaggcaccctt

SEQ ID NO: 2966 - DNA, 20 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
cugaguuuaaaaggcaccct

SEQ ID NO: 2967 - DNA, 19 bp, Artificial Sequence
  Description of Artificial Sequence:  synthetic
  misc_feature (1)..(1): 5'-3 attached terminal deoxyabasic moeity
cugaguuuaaaaggcaccc

SEQ ID NO: 2968 - DNA, 18 bp, Artificial Sequence
  Description of Artificial Sequence:  synthetic
  misc_feature (1)..(1): 5'-3 attached terminal deoxyabasic moeity
cugaguuuaaaaggcacc

SEQ ID NO: 2969 - DNA, 17 bp, Artificial Sequence
  Description of Artificial Sequence:  synthetic
  misc_feature (1)..(1): 5'-3 attached terminal deoxyabasic moeity
cugaguuuaaaaggcac

SEQ ID NO: 2970 - DNA, 15 bp, Artificial Sequence
  Description of Artificial Sequence:  synthetic
  misc_feature (1)..(1): 5'-3 attached terminal deoxyabasic moeity
cugaguuuaaaaggc

SEQ ID NO: 2971 - DNA, 20 bp, Artificial Sequence
  Description of Artificial Sequence:  synthetic
  misc_feature (19)..(19): Phosphorothioate 3'-Internucleotide Linkage
  misc_feature (1)..(19): ribonucleotide modified as described
ggugccuuuuaaacucagtt

SEQ ID NO: 2972 - DNA, 19 bp, Artificial Sequence
  Description of Artificial Sequence:  synthetic
  misc_feature (18)..(18): Phosphorothioate 3'-Internucleotide Linkage
  misc_feature (1)..(17): ribonucleotide
gugccuuuuaaacucagtt

SEQ ID NO: 2973 - DNA, 18 bp, Artificial Sequence
  Description of Artificial Sequence:  synthetic
  misc_feature (17)..(17): Phosphorothioate 3'-Internucleotide Linkage
  misc_feature (1)..(16): ribonucleotide
ugccuuuuaaacucagtt

SEQ ID NO: 2974 - DNA, 17 bp, Artificial Sequence
  Description of Artificial Sequence:  synthetic
  misc_feature (16)..(16): Phosphorothioate 3'-Internucleotide Linkage
  misc_feature (1)..(15): ribonucleotide
gccuuuuaaacucagtt

SEQ ID NO: 2975 - DNA, 16 bp, Artificial Sequence
  Description of Artificial Sequence:  synthetic
  misc_feature (15)..(15): Phosphorothioate 3'-Internucleotide Linkage
  misc_feature (1)..(14): ribonucleotide
ccuuuuaaacucagtt

SEQ ID NO: 2976 - DNA, 20 bp, Artificial Sequence
  Description of Artificial Sequence:  synthetic
  misc_feature (1)..(19): ribonucleotide modified as described
gggugccuuuuaaacucagn

SEQ ID NO: 2977 - DNA, 19 bp, Artificial Sequence
  Description of Artificial Sequence:  synthetic
gggugccuuuuaaacucag

SEQ ID NO: 2978 - DNA, 18 bp, Artificial Sequence
  Description of Artificial Sequence:  synthetic
gggugccuuuuaaacuca

SEQ ID NO: 2979 - DNA, 17 bp, Artificial Sequence
  Description of Artificial Sequence:  synthetic
gggugccuuuuaaacuc

SEQ ID NO: 2980 - DNA, 16 bp, Artificial Sequence
  Description of Artificial Sequence:  synthetic
gggugccuuuuaaacu

SEQ ID NO: 2981 - DNA, 14 bp, Artificial Sequence
  Description of Artificial Sequence:  synthetic
gggugccuuuuaaa

SEQ ID NO: 2982 - DNA, 12 bp, Artificial Sequence
  Description of Artificial Sequence:  synthetic
gggugccuuuua

SEQ ID NO: 2983 - DNA, 36 bp, Artificial Sequence
  Description of Artificial Sequence:  synthetic
  misc_feature (1)..(36): 2'-O-methyl
  misc_feature (35)..(35): Phosphorothioate 3'-Internucleotide Linkage
cuaccagcgaguuuguaguuuaaaaaaaaaaaaaaa

SEQ ID NO: 2984 - DNA, 41 bp, Artificial Sequence
  Description of Artificial Sequence:  synthetic
  misc_feature (40)..(40): Phosphorothioate 3'-Internucleotide Linkage
  misc_feature (41)..(41): 2'-O-methyl
cuaccagcgaguuuguaguuuaaaaaaaaaaaaaaaaaaaa

SEQ ID NO: 2985 - DNA, 46 bp, Artificial Sequence
  Description of Artificial Sequence:  synthetic
  misc_feature (1)..(46): 2'-O-methyl
  misc_feature (45)..(45): Phosphorothioate 3'-Internucleotide Linkage
cuaccagcgaguuuguaguuuaaaaaaaaaaaaaaaaaaaaaaaaa

SEQ ID NO: 2986 - DNA, 51 bp, Artificial Sequence
  Description of Artificial Sequence:  synthetic
  misc_feature (1)..(51): 2'-O-methyl
  misc_feature (50)..(50): Phosphorothioate 3'-Internucleotide Linkage
cuaccagcgaguuuguaguuuaaaaaaaaaaaaaaaaaaaaaaaaaaaaaa

SEQ ID NO: 2987 - DNA, 21 bp, Artificial Sequence
  Description of Artificial Sequence:  synthetic
  misc_feature (1)..(19): ribonucleotide modified as described
cucacugccacucuaauugtt

SEQ ID NO: 2988 - DNA, 21 bp, Artificial Sequence
  Description of Artificial Sequence:  synthetic
  misc_feature (1)..(19): ribonucleotide modified as described
ucacugccacucuaauugutt

SEQ ID NO: 2989 - DNA, 21 bp, Artificial Sequence
  Description of Artificial Sequence:  synthetic
  misc_feature (1)..(19): ribonucleotide modified as described
cacugccacucuaauuguctt

SEQ ID NO: 2990 - DNA, 21 bp, Artificial Sequence
  Description of Artificial Sequence:  synthetic
  misc_feature (1)..(19): ribonucleotide modified as described
gaccccgucucuauaccaatt

SEQ ID NO: 2991 - DNA, 21 bp, Artificial Sequence
  Description of Artificial Sequence:  synthetic
  misc_feature (1)..(19): ribonucleotide modified as described
caauuagaguggcagugagtt

SEQ ID NO: 2992 - DNA, 21 bp, Artificial Sequence
  Description of Artificial Sequence:  synthetic
  misc_feature (1)..(19): ribonucleotide modified as described
acaauuagaguggcagugatt

SEQ ID NO: 2993 - DNA, 21 bp, Artificial Sequence
  Description of Artificial Sequence:  synthetic
  misc_feature (1)..(19): ribonucleotide modified as described
gacaauuagaguggcagugtt

SEQ ID NO: 2994 - DNA, 21 bp, Artificial Sequence
  Description of Artificial Sequence:  synthetic
  misc_feature (1)..(19): ribonucleotide modified as described
uugguauagagacgggguctt

SEQ ID NO: 2995 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(5): 2'-deoxy
  misc_feature (6)..(8): 2'-deoxy-2'-fluoro
  misc_feature (9)..(19): 2'-deoxy
  misc_feature (1)..(19): ribonucleotide modified as described
  misc_feature (21)..(21): 3'-3 attached terminal deoxyabasic moeity
cugaguuuaaaaggcaccctt

SEQ ID NO: 2996 - DNA, 21 bp, Artificial Sequence
  Description of Artificial Sequence:  synthetic
  misc_feature (1)..(3): 2'-O-methyl
  misc_feature (5)..(5): 2'-O-methyl
  misc_feature (7)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 2997 - DNA, 21 bp, Artificial Sequence
  Description of Artificial Sequence:  synthetic
  misc_feature (1)..(3): 2'-O-methyl
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 2998 - DNA, 21 bp, Artificial Sequence
  Description of Artificial Sequence:  synthetic
  misc_feature (1)..(3): 2'-O-methyl
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide
gggugccuuuuaaacucagtt

SEQ ID NO: 2999 - DNA, 21 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (15)..(17): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 3000 - DNA, 21 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (15)..(17): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 3001 - DNA, 21 bp, Artificial Sequence
  Description of Artificial Sequence:  synthetic
  misc_feature (2)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide modified as described
gggugccuuuuaaacucagtt

SEQ ID NO: 3002 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy
  misc_feature (4)..(5): 2'-deoxy-2'-fluoro
  misc_feature (6)..(8): 2'-deoxy
  misc_feature (9)..(11): 2'-deoxy-2'-fluoro
  misc_feature (12)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
gaacugaguuuaaaaggcatt

SEQ ID NO: 3003 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(5): 2'-deoxy-2'-fluoro
  misc_feature (6)..(8): 2'-deoxy
  misc_feature (9)..(11): 2'-deoxy-2'-fluoro
  misc_feature (12)..(19): 2'-deoxy
  misc_feature (1)..(19): ribonucleotide modified as described
  misc_feature (21)..(21): 3'-3 attached terminal deoxyabasic moeity
gaacugaguuuaaaaggcatt

SEQ ID NO: 3004 - DNA, 21 bp, Artificial Sequence
  Description of Artificial Sequence:  synthetic
  misc_feature (2)..(2): 2'-O-methyl
  misc_feature (3)..(8): 2'-deoxy-2'-fluoro
  misc_feature (9)..(11): 2'-O-methyl
  misc_feature (12)..(14): 2'-deoxy-2'-fluoro
  misc_feature (15)..(16): 2'-O-methyl
  misc_feature (17)..(18): 2'-deoxy-2'-fluoro
  misc_feature (20)..(20): Phosphorothioate 3'-Internucleotide Linkage
  misc_feature (1)..(19): ribonucleotide modified as described
ugccuuuuaaacucaguuctt

SEQ ID NO: 3005 - DNA, 21 bp, Artificial Sequence
  Description of Artificial Sequence:  synthetic
  misc_feature (1)..(2): 2'-O-methyl
  misc_feature (3)..(8): 2'-deoxy-2'-fluoro
  misc_feature (9)..(11): 2'-O-methyl
  misc_feature (12)..(14): 2'-deoxy-2'-fluoro
  misc_feature (15)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
ugccuuuuaaacucaguuctt

SEQ ID NO: 3006 - DNA, 21 bp, Artificial Sequence
  Description of Artificial Sequence:  synthetic
  misc_feature (2)..(3): 2'-O-methyl
  misc_feature (4)..(8): 2'-deoxy-2'-fluoro
  misc_feature (9)..(11): 2'-O-methyl
  misc_feature (12)..(14): 2'-deoxy-2'-fluoro
  misc_feature (15)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
ugccuuuuaaacucaguuctt

SEQ ID NO: 3007 - DNA, 21 bp, Artificial Sequence
  Description of Artificial Sequence:  synthetic
  misc_feature (1)..(3): 2'-deoxy
  misc_feature (4)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
gaacugaguuuaaaaggcatt

SEQ ID NO: 3008 - DNA, 21 bp, Artificial Sequence
  Description of Artificial Sequence:  synthetic
  misc_feature (1)..(2): 2'-O-methyl
  misc_feature (3)..(7): 2'-deoxy-2'-fluoro
  misc_feature (8)..(11): 2'-O-methyl
  misc_feature (12)..(14): 2'-deoxy-2'-fluoro
  misc_feature (15)..(17): 2'-O-methyl
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
ugccuuuuaaacucaguuctt

SEQ ID NO: 3009 - DNA, 21 bp, Artificial Sequence
  Description of Artificial Sequence:  synthetic
  misc_feature (1)..(19): ribonucleotide modified as described
gcgggcuccggggcucgggtt

SEQ ID NO: 3010 - DNA, 21 bp, Artificial Sequence
  Description of Artificial Sequence:  synthetic
  misc_feature (1)..(19): ribonucleotide modified as described
ggcuggagccgcgagacggtt

SEQ ID NO: 3011 - DNA, 21 bp, Artificial Sequence
  Description of Artificial Sequence:  synthetic
  misc_feature (1)..(19): ribonucleotide modified as described
gcuggagccgcgagacgggtt

SEQ ID NO: 3012 - DNA, 21 bp, Artificial Sequence
  Description of Artificial Sequence:  synthetic
  misc_feature (1)..(19): ribonucleotide modified as described
uggucagcuacugggacactt

SEQ ID NO: 3013 - DNA, 21 bp, Artificial Sequence
  Description of Artificial Sequence:  synthetic
  misc_feature (1)..(19): ribonucleotide modified as described
ggucagcuacugggacacctt

SEQ ID NO: 3014 - DNA, 21 bp, Artificial Sequence
  Description of Artificial Sequence:  synthetic
  misc_feature (1)..(19): ribonucleotide modified as described
uuuaaaaggcacccagcactt

SEQ ID NO: 3015 - DNA, 21 bp, Artificial Sequence
  Description of Artificial Sequence:  synthetic
  misc_feature (1)..(19): ribonucleotide modified as described
cagcccauaaauggucuuutt

SEQ ID NO: 3016 - DNA, 21 bp, Artificial Sequence
  Description of Artificial Sequence:  synthetic
  misc_feature (1)..(19): ribonucleotide modified as described
aaagaagaaggaaacagaatt

SEQ ID NO: 3017 - DNA, 21 bp, Artificial Sequence
  Description of Artificial Sequence:  synthetic
  misc_feature (1)..(19): ribonucleotide modified as described
aagaagaaggaaacagaautt

SEQ ID NO: 3018 - DNA, 21 bp, Artificial Sequence
  Description of Artificial Sequence:  synthetic
  misc_feature (1)..(19): ribonucleotide modified as described
cucgucauucccugccgggtt

SEQ ID NO: 3019 - DNA, 21 bp, Artificial Sequence
  Description of Artificial Sequence:  synthetic
  misc_feature (1)..(19): ribonucleotide modified as described
ucgucauucccugccgggutt

SEQ ID NO: 3020 - DNA, 21 bp, Artificial Sequence
  Description of Artificial Sequence:  synthetic
  misc_feature (1)..(19): ribonucleotide modified as described
aaaaguuuccacuugacactt

SEQ ID NO: 3021 - DNA, 21 bp, Artificial Sequence
  Description of Artificial Sequence:  synthetic
  misc_feature (1)..(19): ribonucleotide modified as described
aaaguuuccacuugacacutt

SEQ ID NO: 3022 - DNA, 21 bp, Artificial Sequence
  Description of Artificial Sequence:  synthetic
  misc_feature (1)..(19): ribonucleotide modified as described
cgcauaaucugggacaguatt

SEQ ID NO: 3023 - DNA, 21 bp, Artificial Sequence
  Description of Artificial Sequence:  synthetic
  misc_feature (1)..(19): ribonucleotide modified as described
gcauaaucugggacaguagtt

SEQ ID NO: 3024 - DNA, 21 bp, Artificial Sequence
  Description of Artificial Sequence:  synthetic
  misc_feature (1)..(19): ribonucleotide modified as described
cauaaucugggacaguagatt

SEQ ID NO: 3025 - DNA, 21 bp, Artificial Sequence
  Description of Artificial Sequence:  synthetic
  misc_feature (1)..(19): ribonucleotide modified as described
auaaucugggacaguagaatt

SEQ ID NO: 3026 - DNA, 21 bp, Artificial Sequence
  Description of Artificial Sequence:  synthetic
  misc_feature (1)..(19): ribonucleotide modified as described
ccucagugcauauauaugatt

SEQ ID NO: 3027 - DNA, 21 bp, Artificial Sequence
  Description of Artificial Sequence:  synthetic
  misc_feature (1)..(19): ribonucleotide modified as described
gaagaggaugcagggaauutt

SEQ ID NO: 3028 - DNA, 21 bp, Artificial Sequence
  Description of Artificial Sequence:  synthetic
  misc_feature (1)..(19): ribonucleotide modified as described
acgaaaaggccgugucauctt

SEQ ID NO: 3029 - DNA, 21 bp, Artificial Sequence
  Description of Artificial Sequence:  synthetic
  misc_feature (1)..(19): ribonucleotide modified as described
ucaagugguucuggcaccctt

SEQ ID NO: 3030 - DNA, 21 bp, Artificial Sequence
  Description of Artificial Sequence:  synthetic
  misc_feature (1)..(19): ribonucleotide modified as described
cauaaucauuccgaagcaatt

SEQ ID NO: 3031 - DNA, 21 bp, Artificial Sequence
  Description of Artificial Sequence:  synthetic
  misc_feature (1)..(19): ribonucleotide modified as described
cugugggaagaaacauaagtt

SEQ ID NO: 3032 - DNA, 21 bp, Artificial Sequence
  Description of Artificial Sequence:  synthetic
  misc_feature (1)..(19): ribonucleotide modified as described
ccucagugaucacacagugtt

SEQ ID NO: 3033 - DNA, 21 bp, Artificial Sequence
  Description of Artificial Sequence:  synthetic
  misc_feature (1)..(19): ribonucleotide modified as described
cucagugaucacacaguggtt

SEQ ID NO: 3034 - DNA, 21 bp, Artificial Sequence
  Description of Artificial Sequence:  synthetic
  misc_feature (1)..(19): ribonucleotide modified as described
agccuggaauuauuuuaggtt

SEQ ID NO: 3035 - DNA, 21 bp, Artificial Sequence
  Description of Artificial Sequence:  synthetic
  misc_feature (1)..(19): ribonucleotide modified as described
agaagaggaugaagguguctt

SEQ ID NO: 3036 - DNA, 21 bp, Artificial Sequence
  Description of Artificial Sequence:  synthetic
  misc_feature (1)..(19): ribonucleotide modified as described
uaaucuggagcugaucacutt

SEQ ID NO: 3037 - DNA, 21 bp, Artificial Sequence
  Description of Artificial Sequence:  synthetic
  misc_feature (1)..(19): ribonucleotide modified as described
cuggagcugaucacucuaatt

SEQ ID NO: 3038 - DNA, 21 bp, Artificial Sequence
  Description of Artificial Sequence:  synthetic
  misc_feature (1)..(19): ribonucleotide modified as described
caagugggaguuugcccggtt

SEQ ID NO: 3039 - DNA, 21 bp, Artificial Sequence
  Description of Artificial Sequence:  synthetic
  misc_feature (1)..(19): ribonucleotide modified as described
uuaagaaaucaccuacgugtt

SEQ ID NO: 3040 - DNA, 21 bp, Artificial Sequence
  Description of Artificial Sequence:  synthetic
  misc_feature (1)..(19): ribonucleotide modified as described
auggugauuguugaauacutt

SEQ ID NO: 3041 - DNA, 21 bp, Artificial Sequence
  Description of Artificial Sequence:  synthetic
  misc_feature (1)..(19): ribonucleotide modified as described
aagaaaaaauggagccaggtt

SEQ ID NO: 3042 - DNA, 21 bp, Artificial Sequence
  Description of Artificial Sequence:  synthetic
  misc_feature (1)..(19): ribonucleotide modified as described
caaggcaagaaaccaagactt

SEQ ID NO: 3043 - DNA, 21 bp, Artificial Sequence
  Description of Artificial Sequence:  synthetic
  misc_feature (1)..(19): ribonucleotide modified as described
aaggcaagaaaccaagacutt

SEQ ID NO: 3044 - DNA, 21 bp, Artificial Sequence
  Description of Artificial Sequence:  synthetic
  misc_feature (1)..(19): ribonucleotide modified as described
gugauguugaggaagaggatt

SEQ ID NO: 3045 - DNA, 21 bp, Artificial Sequence
  Description of Artificial Sequence:  synthetic
  misc_feature (1)..(19): ribonucleotide modified as described
ugauguugaggaagaggagtt

SEQ ID NO: 3046 - DNA, 21 bp, Artificial Sequence
  Description of Artificial Sequence:  synthetic
  misc_feature (1)..(19): ribonucleotide modified as described
uacaguuuucaaguggccatt

SEQ ID NO: 3047 - DNA, 21 bp, Artificial Sequence
  Description of Artificial Sequence:  synthetic
  misc_feature (1)..(19): ribonucleotide modified as described
acaguuuucaaguggccagtt

SEQ ID NO: 3048 - DNA, 21 bp, Artificial Sequence
  Description of Artificial Sequence:  synthetic
  misc_feature (1)..(19): ribonucleotide modified as described
uucaaguggccagaggcautt

SEQ ID NO: 3049 - DNA, 21 bp, Artificial Sequence
  Description of Artificial Sequence:  synthetic
  misc_feature (1)..(19): ribonucleotide modified as described
ucaaguggccagaggcaugtt

SEQ ID NO: 3050 - DNA, 21 bp, Artificial Sequence
  Description of Artificial Sequence:  synthetic
  misc_feature (1)..(19): ribonucleotide modified as described
cagaaagugcauucaucggtt

SEQ ID NO: 3051 - DNA, 21 bp, Artificial Sequence
  Description of Artificial Sequence:  synthetic
  misc_feature (1)..(19): ribonucleotide modified as described
cgagaaacauucuuuuauctt

SEQ ID NO: 3052 - DNA, 21 bp, Artificial Sequence
  Description of Artificial Sequence:  synthetic
  misc_feature (1)..(19): ribonucleotide modified as described
gagaaacauucuuuuaucutt

SEQ ID NO: 3053 - DNA, 21 bp, Artificial Sequence
  Description of Artificial Sequence:  synthetic
  misc_feature (1)..(19): ribonucleotide modified as described
agaaacauucuuuuaucugtt

SEQ ID NO: 3054 - DNA, 21 bp, Artificial Sequence
  Description of Artificial Sequence:  synthetic
  misc_feature (1)..(19): ribonucleotide modified as described
gcugugggaaaucuucucctt

SEQ ID NO: 3055 - DNA, 21 bp, Artificial Sequence
  Description of Artificial Sequence:  synthetic
  misc_feature (1)..(19): ribonucleotide modified as described
ccuucucugaggacuucuutt

SEQ ID NO: 3056 - DNA, 21 bp, Artificial Sequence
  Description of Artificial Sequence:  synthetic
  misc_feature (1)..(19): ribonucleotide modified as described
aggaagcucugaugauguctt

SEQ ID NO: 3057 - DNA, 21 bp, Artificial Sequence
  Description of Artificial Sequence:  synthetic
  misc_feature (1)..(19): ribonucleotide modified as described
ggaagcucugaugaugucatt

SEQ ID NO: 3058 - DNA, 21 bp, Artificial Sequence
  Description of Artificial Sequence:  synthetic
  misc_feature (1)..(19): ribonucleotide modified as described
aaguucaugagccuggaaatt

SEQ ID NO: 3059 - DNA, 21 bp, Artificial Sequence
  Description of Artificial Sequence:  synthetic
  misc_feature (1)..(19): ribonucleotide modified as described
aguucaugagccuggaaagtt

SEQ ID NO: 3060 - DNA, 21 bp, Artificial Sequence
  Description of Artificial Sequence:  synthetic
  misc_feature (1)..(19): ribonucleotide modified as described
agccuggaaagaaucaaaatt

SEQ ID NO: 3061 - DNA, 21 bp, Artificial Sequence
  Description of Artificial Sequence:  synthetic
  misc_feature (1)..(19): ribonucleotide modified as described
gcugugggcacgucagcgatt

SEQ ID NO: 3062 - DNA, 21 bp, Artificial Sequence
  Description of Artificial Sequence:  synthetic
  misc_feature (1)..(19): ribonucleotide modified as described
aaggcaagcgcagguucactt

SEQ ID NO: 3063 - DNA, 21 bp, Artificial Sequence
  Description of Artificial Sequence:  synthetic
  misc_feature (1)..(19): ribonucleotide modified as described
cagcccaaaacccagggcatt

SEQ ID NO: 3064 - DNA, 21 bp, Artificial Sequence
  Description of Artificial Sequence:  synthetic
  misc_feature (1)..(19): ribonucleotide modified as described
ggcaagaaaaggacaaauatt

SEQ ID NO: 3065 - DNA, 21 bp, Artificial Sequence
  Description of Artificial Sequence:  synthetic
  misc_feature (1)..(19): ribonucleotide modified as described
ggcuccucuaguaagaugctt

SEQ ID NO: 3066 - DNA, 21 bp, Artificial Sequence
  Description of Artificial Sequence:  synthetic
  misc_feature (1)..(19): ribonucleotide modified as described
cuccaggccaugauggccutt

SEQ ID NO: 3067 - DNA, 21 bp, Artificial Sequence
  Description of Artificial Sequence:  synthetic
  misc_feature (1)..(19): ribonucleotide modified as described
uccaggccaugauggccuutt

SEQ ID NO: 3068 - DNA, 21 bp, Artificial Sequence
  Description of Artificial Sequence:  synthetic
  misc_feature (1)..(19): ribonucleotide modified as described
accccgucucuauaccaactt

SEQ ID NO: 3069 - DNA, 21 bp, Artificial Sequence
  Description of Artificial Sequence:  synthetic
  misc_feature (1)..(19): ribonucleotide modified as described
cccgucucuauaccaaccatt

SEQ ID NO: 3070 - DNA, 21 bp, Artificial Sequence
  Description of Artificial Sequence:  synthetic
  misc_feature (1)..(19): ribonucleotide modified as described
ccgucucuauaccaaccaatt

SEQ ID NO: 3071 - DNA, 21 bp, Artificial Sequence
  Description of Artificial Sequence:  synthetic
  misc_feature (1)..(19): ribonucleotide modified as described
ucaagugggccuuggaucgtt

SEQ ID NO: 3072 - DNA, 21 bp, Artificial Sequence
  Description of Artificial Sequence:  synthetic
  misc_feature (1)..(19): ribonucleotide modified as described
caagugggccuuggaucgctt

SEQ ID NO: 3073 - DNA, 21 bp, Artificial Sequence
  Description of Artificial Sequence:  synthetic
  misc_feature (1)..(19): ribonucleotide modified as described
cccgagccccggagcccgctt

SEQ ID NO: 3074 - DNA, 21 bp, Artificial Sequence
  Description of Artificial Sequence:  synthetic
  misc_feature (1)..(19): ribonucleotide modified as described
ccgucucgcggcuccagcctt

SEQ ID NO: 3075 - DNA, 21 bp, Artificial Sequence
  Description of Artificial Sequence:  synthetic
  misc_feature (1)..(19): ribonucleotide modified as described
cccgucucgcggcuccagctt

SEQ ID NO: 3076 - DNA, 21 bp, Artificial Sequence
  Description of Artificial Sequence:  synthetic
  misc_feature (1)..(19): ribonucleotide modified as described
gugucccaguagcugaccatt

SEQ ID NO: 3077 - DNA, 21 bp, Artificial Sequence
  Description of Artificial Sequence:  synthetic
  misc_feature (1)..(19): ribonucleotide modified as described
ggugucccaguagcugacctt

SEQ ID NO: 3078 - DNA, 21 bp, Artificial Sequence
  Description of Artificial Sequence:  synthetic
  misc_feature (1)..(19): ribonucleotide modified as described
gugcugggugccuuuuaaatt

SEQ ID NO: 3079 - DNA, 21 bp, Artificial Sequence
  Description of Artificial Sequence:  synthetic
  misc_feature (1)..(19): ribonucleotide modified as described
aaagaccauuuaugggcugtt

SEQ ID NO: 3080 - DNA, 21 bp, Artificial Sequence
  Description of Artificial Sequence:  synthetic
  misc_feature (1)..(19): ribonucleotide modified as described
uucuguuuccuucuucuuutt

SEQ ID NO: 3081 - DNA, 21 bp, Artificial Sequence
  Description of Artificial Sequence:  synthetic
  misc_feature (1)..(19): ribonucleotide modified as described
auucuguuuccuucuucuutt

SEQ ID NO: 3082 - DNA, 21 bp, Artificial Sequence
  Description of Artificial Sequence:  synthetic
  misc_feature (1)..(19): ribonucleotide modified as described
cccggcagggaaugacgagtt

SEQ ID NO: 3083 - DNA, 21 bp, Artificial Sequence
  Description of Artificial Sequence:  synthetic
  misc_feature (1)..(19): ribonucleotide modified as described
acccggcagggaaugacgatt

SEQ ID NO: 3084 - DNA, 21 bp, Artificial Sequence
  Description of Artificial Sequence:  synthetic
  misc_feature (1)..(19): ribonucleotide modified as described
gugucaaguggaaacuuuutt

SEQ ID NO: 3085 - DNA, 21 bp, Artificial Sequence
  Description of Artificial Sequence:  synthetic
  misc_feature (1)..(19): ribonucleotide modified as described
agugucaaguggaaacuuutt

SEQ ID NO: 3086 - DNA, 21 bp, Artificial Sequence
  Description of Artificial Sequence:  synthetic
  misc_feature (1)..(19): ribonucleotide modified as described
uacugucccagauuaugcgtt

SEQ ID NO: 3087 - DNA, 21 bp, Artificial Sequence
  Description of Artificial Sequence:  synthetic
  misc_feature (1)..(19): ribonucleotide modified as described
cuacugucccagauuaugctt

SEQ ID NO: 3088 - DNA, 21 bp, Artificial Sequence
  Description of Artificial Sequence:  synthetic
  misc_feature (1)..(19): ribonucleotide modified as described
ucuacugucccagauuaugtt

SEQ ID NO: 3089 - DNA, 21 bp, Artificial Sequence
  Description of Artificial Sequence:  synthetic
  misc_feature (1)..(19): ribonucleotide modified as described
uucuacugucccagauuautt

SEQ ID NO: 3090 - DNA, 21 bp, Artificial Sequence
  Description of Artificial Sequence:  synthetic
  misc_feature (1)..(19): ribonucleotide modified as described
ucauauauaugcacugaggtt

SEQ ID NO: 3091 - DNA, 21 bp, Artificial Sequence
  Description of Artificial Sequence:  synthetic
  misc_feature (1)..(19): ribonucleotide modified as described
aauucccugcauccucuuctt

SEQ ID NO: 3092 - DNA, 21 bp, Artificial Sequence
  Description of Artificial Sequence:  synthetic
  misc_feature (1)..(19): ribonucleotide modified as described
gaugacacggccuuuucgutt

SEQ ID NO: 3093 - DNA, 21 bp, Artificial Sequence
  Description of Artificial Sequence:  synthetic
  misc_feature (1)..(19): ribonucleotide modified as described
gggugccagaaccacuugatt

SEQ ID NO: 3094 - DNA, 21 bp, Artificial Sequence
  Description of Artificial Sequence:  synthetic
  misc_feature (1)..(19): ribonucleotide modified as described
uugcuucggaaugauuaugtt

SEQ ID NO: 3095 - DNA, 21 bp, Artificial Sequence
  Description of Artificial Sequence:  synthetic
  misc_feature (1)..(19): ribonucleotide modified as described
cuuauguuucuucccacagtt

SEQ ID NO: 3096 - DNA, 21 bp, Artificial Sequence
  Description of Artificial Sequence:  synthetic
  misc_feature (1)..(19): ribonucleotide modified as described
cacugugugaucacugaggtt

SEQ ID NO: 3097 - DNA, 21 bp, Artificial Sequence
  Description of Artificial Sequence:  synthetic
  misc_feature (1)..(19): ribonucleotide modified as described
ccacugugugaucacugagtt

SEQ ID NO: 3098 - DNA, 21 bp, Artificial Sequence
  Description of Artificial Sequence:  synthetic
  misc_feature (1)..(19): ribonucleotide modified as described
ccuaaaauaauuccaggcutt

SEQ ID NO: 3099 - DNA, 21 bp, Artificial Sequence
  Description of Artificial Sequence:  synthetic
  misc_feature (1)..(19): ribonucleotide modified as described
gacaccuucauccucuucutt

SEQ ID NO: 3100 - DNA, 21 bp, Artificial Sequence
  Description of Artificial Sequence:  synthetic
  misc_feature (1)..(19): ribonucleotide modified as described
agugaucagcuccagauuatt

SEQ ID NO: 3101 - DNA, 21 bp, Artificial Sequence
  Description of Artificial Sequence:  synthetic
  misc_feature (1)..(19): ribonucleotide modified as described
uuagagugaucagcuccagtt

SEQ ID NO: 3102 - DNA, 21 bp, Artificial Sequence
  Description of Artificial Sequence:  synthetic
  misc_feature (1)..(19): ribonucleotide modified as described
ccgggcaaacucccacuugtt

SEQ ID NO: 3103 - DNA, 21 bp, Artificial Sequence
  Description of Artificial Sequence:  synthetic
  misc_feature (1)..(19): ribonucleotide modified as described
cacguaggugauuucuuaatt

SEQ ID NO: 3104 - DNA, 21 bp, Artificial Sequence
  Description of Artificial Sequence:  synthetic
  misc_feature (1)..(19): ribonucleotide modified as described
aguauucaacaaucaccautt

SEQ ID NO: 3105 - DNA, 21 bp, Artificial Sequence
  Description of Artificial Sequence:  synthetic
  misc_feature (1)..(19): ribonucleotide modified as described
ccuggcuccauuuuuucuutt

SEQ ID NO: 3106 - DNA, 21 bp, Artificial Sequence
  Description of Artificial Sequence:  synthetic
  misc_feature (1)..(19): ribonucleotide modified as described
gucuugguuucuugccuugtt

SEQ ID NO: 3107 - DNA, 21 bp, Artificial Sequence
  Description of Artificial Sequence:  synthetic
  misc_feature (1)..(19): ribonucleotide modified as described
agucuugguuucuugccuutt

SEQ ID NO: 3108 - DNA, 21 bp, Artificial Sequence
  Description of Artificial Sequence:  synthetic
  misc_feature (1)..(19): ribonucleotide modified as described
uccucuuccucaacaucactt

SEQ ID NO: 3109 - DNA, 21 bp, Artificial Sequence
  Description of Artificial Sequence:  synthetic
  misc_feature (1)..(19): ribonucleotide modified as described
cuccucuuccucaacaucatt

SEQ ID NO: 3110 - DNA, 21 bp, Artificial Sequence
  Description of Artificial Sequence:  synthetic
  misc_feature (1)..(19): ribonucleotide modified as described
uggccacuugaaaacuguatt

SEQ ID NO: 3111 - DNA, 21 bp, Artificial Sequence
  Description of Artificial Sequence:  synthetic
  misc_feature (1)..(19): ribonucleotide modified as described
cuggccacuugaaaacugutt

SEQ ID NO: 3112 - DNA, 21 bp, Artificial Sequence
  Description of Artificial Sequence:  synthetic
  misc_feature (1)..(19): ribonucleotide modified as described
augccucuggccacuugaatt

SEQ ID NO: 3113 - DNA, 21 bp, Artificial Sequence
  Description of Artificial Sequence:  synthetic
  misc_feature (1)..(19): ribonucleotide modified as described
caugccucuggccacuugatt

SEQ ID NO: 3114 - DNA, 21 bp, Artificial Sequence
  Description of Artificial Sequence:  synthetic
  misc_feature (1)..(19): ribonucleotide modified as described
ccgaugaaugcacuuucugtt

SEQ ID NO: 3115 - DNA, 21 bp, Artificial Sequence
  Description of Artificial Sequence:  synthetic
  misc_feature (1)..(19): ribonucleotide modified as described
gauaaaagaauguuucucgtt

SEQ ID NO: 3116 - DNA, 21 bp, Artificial Sequence
  Description of Artificial Sequence:  synthetic
  misc_feature (1)..(19): ribonucleotide modified as described
agauaaaagaauguuucuctt

SEQ ID NO: 3117 - DNA, 21 bp, Artificial Sequence
  Description of Artificial Sequence:  synthetic
  misc_feature (1)..(19): ribonucleotide modified as described
cagauaaaagaauguuucutt

SEQ ID NO: 3118 - DNA, 21 bp, Artificial Sequence
  Description of Artificial Sequence:  synthetic
  misc_feature (1)..(19): ribonucleotide modified as described
ggagaagauuucccacagctt

SEQ ID NO: 3119 - DNA, 21 bp, Artificial Sequence
  Description of Artificial Sequence:  synthetic
  misc_feature (1)..(19): ribonucleotide modified as described
aagaaguccucagagaaggtt

SEQ ID NO: 3120 - DNA, 21 bp, Artificial Sequence
  Description of Artificial Sequence:  synthetic
  misc_feature (1)..(19): ribonucleotide modified as described
gacaucaucagagcuuccutt

SEQ ID NO: 3121 - DNA, 21 bp, Artificial Sequence
  Description of Artificial Sequence:  synthetic
  misc_feature (1)..(19): ribonucleotide modified as described
ugacaucaucagagcuucctt

SEQ ID NO: 3122 - DNA, 21 bp, Artificial Sequence
  Description of Artificial Sequence:  synthetic
  misc_feature (1)..(19): ribonucleotide modified as described
uuuccaggcucaugaacuutt

SEQ ID NO: 3123 - DNA, 21 bp, Artificial Sequence
  Description of Artificial Sequence:  synthetic
  misc_feature (1)..(19): ribonucleotide modified as described
cuuuccaggcucaugaacutt

SEQ ID NO: 3124 - DNA, 21 bp, Artificial Sequence
  Description of Artificial Sequence:  synthetic
  misc_feature (1)..(19): ribonucleotide modified as described
uuuugauucuuuccaggcutt

SEQ ID NO: 3125 - DNA, 21 bp, Artificial Sequence
  Description of Artificial Sequence:  synthetic
  misc_feature (1)..(19): ribonucleotide modified as described
ucgcugacgugcccacagctt

SEQ ID NO: 3126 - DNA, 21 bp, Artificial Sequence
  Description of Artificial Sequence:  synthetic
  misc_feature (1)..(19): ribonucleotide modified as described
gugaaccugcgcuugccuutt

SEQ ID NO: 3127 - DNA, 21 bp, Artificial Sequence
  Description of Artificial Sequence:  synthetic
  misc_feature (1)..(19): ribonucleotide modified as described
ugcccuggguuuugggcugtt

SEQ ID NO: 3128 - DNA, 21 bp, Artificial Sequence
  Description of Artificial Sequence:  synthetic
  misc_feature (1)..(19): ribonucleotide modified as described
uauuuguccuuuucuugcctt

SEQ ID NO: 3129 - DNA, 21 bp, Artificial Sequence
  Description of Artificial Sequence:  synthetic
  misc_feature (1)..(19): ribonucleotide modified as described
gcaucuuacuagaggagcctt

SEQ ID NO: 3130 - DNA, 21 bp, Artificial Sequence
  Description of Artificial Sequence:  synthetic
  misc_feature (1)..(19): ribonucleotide modified as described
aggccaucauggccuggagtt

SEQ ID NO: 3131 - DNA, 21 bp, Artificial Sequence
  Description of Artificial Sequence:  synthetic
  misc_feature (1)..(19): ribonucleotide modified as described
aaggccaucauggccuggatt

SEQ ID NO: 3132 - DNA, 21 bp, Artificial Sequence
  Description of Artificial Sequence:  synthetic
  misc_feature (1)..(19): ribonucleotide modified as described
guugguauagagacggggutt

SEQ ID NO: 3133 - DNA, 21 bp, Artificial Sequence
  Description of Artificial Sequence:  synthetic
  misc_feature (1)..(19): ribonucleotide modified as described
ugguugguauagagacgggtt

SEQ ID NO: 3134 - DNA, 21 bp, Artificial Sequence
  Description of Artificial Sequence:  synthetic
  misc_feature (1)..(19): ribonucleotide modified as described
uugguugguauagagacggtt

SEQ ID NO: 3135 - DNA, 21 bp, Artificial Sequence
  Description of Artificial Sequence:  synthetic
  misc_feature (1)..(19): ribonucleotide modified as described
cgauccaaggcccacuugatt

SEQ ID NO: 3136 - DNA, 21 bp, Artificial Sequence
  Description of Artificial Sequence:  synthetic
  misc_feature (1)..(19): ribonucleotide modified as described
gcgauccaaggcccacuugtt

SEQ ID NO: 3137 - DNA, 21 bp, Artificial Sequence
  Description of Artificial Sequence:  synthetic
  misc_feature (1)..(19): ribonucleotide modified as described
gaacugaguuuaaaaggcatt

SEQ ID NO: 3138 - DNA, 21 bp, Artificial Sequence
  Description of Artificial Sequence:  synthetic
  misc_feature (1)..(19): ribonucleotide modified as described
ugccuuuuaaacucaguuctt

SEQ ID NO: 3139 - DNA, 19 bp, Artificial Sequence
  Description of Artificial Sequence:  synthetic
cugaguuuaaaaggcaccc

SEQ ID NO: 3140 - DNA, 21 bp, Artificial Sequence
  Description of Artificial Sequence:  synthetic
  misc_feature (1)..(1): 5'-3 attached terminal deoxyabasic moeity
  misc_feature (20)..(20): Phosphorothioate 3'-Internucleotide Linkage
  misc_feature (21)..(21): 3'-3 attached terminal deoxyabasic moeity
gggugccuuuuaaacucagtt

SEQ ID NO: 3141 - DNA, 19 bp, Artificial Sequence
  Description of Artificial Sequence:  synthetic
  misc_feature (1)..(1): 5'-3 attached terminal deoxyabasic moeity
gggugccuuuuaaacucag

SEQ ID NO: 3142 - DNA, 21 bp, Artificial Sequence
  Description of Artificial Sequence:  synthetic
  misc_feature (1)..(2): 2'-deoxy-2'-fluoro
  misc_feature (6)..(8): 2'-deoxy-2'-fluoro
  misc_feature (15)..(15): 2'-deoxy-2'-fluoro
  misc_feature (17)..(19): 2'-deoxy-2'-fluoro
  misc_feature (1)..(19): ribonucleotide modified as described
cugaguuuaaaaggcaccctt

SEQ ID NO: 3143 - DNA, 19 bp, Artificial Sequence
  Description of Artificial Sequence:  synthetic
  misc_feature (1)..(2): 2'-deoxy-2'-fluoro
  misc_feature (6)..(8): 2'-deoxy-2'-fluoro
  misc_feature (15)..(15): 2'-deoxy-2'-fluoro
  misc_feature (17)..(19): 2'-deoxy-2'-fluoro
cugaguuuaaaaggcaccc

SEQ ID NO: 3144 - DNA, 19 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
gggugccuuuuaaacucag

SEQ ID NO: 3145 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(3): 2'-deoxy-2'-fluoro
  misc_feature (4)..(5): 2'-deoxy
  misc_feature (6)..(7): 2'-deoxy-2'-fluoro
  misc_feature (8)..(8): 2'-deoxy
  misc_feature (9)..(9): 2'-deoxy-2'-fluoro
  misc_feature (10)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aacaaccacaaaauacaactt

SEQ ID NO: 3146 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(19): 2'-deoxy
  misc_feature (1)..(19): ribonucleotide modified as described
  misc_feature (21)..(21): 3'-3 attached terminal deoxyabasic moeity
accacaaaauacaacaagatt

SEQ ID NO: 3147 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy
  misc_feature (5)..(6): 2'-deoxy-2'-fluoro
  misc_feature (7)..(7): 2'-deoxy
  misc_feature (8)..(11): 2'-deoxy-2'-fluoro
  misc_feature (12)..(15): 2'-deoxy
  misc_feature (16)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ggaauuauuuuaggaccagtt

SEQ ID NO: 3148 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (7)..(7): 2'-deoxy
  misc_feature (8)..(10): 2'-deoxy-2'-fluoro
  misc_feature (11)..(11): 2'-deoxy
  misc_feature (12)..(13): 2'-deoxy-2'-fluoro
  misc_feature (14)..(19): 2'-deoxy
  misc_feature (1)..(19): ribonucleotide modified as described
  misc_feature (21)..(21): 3'-3 attached terminal deoxyabasic moeity
cacgcuguuuauugaaagatt

SEQ ID NO: 3149 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(9): 2'-deoxy-2'-fluoro
  misc_feature (10)..(10): 2'-deoxy
  misc_feature (11)..(12): 2'-deoxy-2'-fluoro
  misc_feature (13)..(19): 2'-deoxy
  misc_feature (1)..(19): ribonucleotide modified as described
  misc_feature (21)..(21): 3'-3 attached terminal deoxyabasic moeity
acgcuguuuauugaaagagtt

SEQ ID NO: 3150 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(4): 2'-deoxy-2'-fluoro
  misc_feature (5)..(5): 2'-deoxy
  misc_feature (6)..(8): 2'-deoxy-2'-fluoro
  misc_feature (9)..(9): 2'-deoxy
  misc_feature (10)..(11): 2'-deoxy-2'-fluoro
  misc_feature (12)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cgcuguuuauugaaagagutt

SEQ ID NO: 3151 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(3): 2'-deoxy-2'-fluoro
  misc_feature (4)..(4): 2'-deoxy
  misc_feature (5)..(7): 2'-deoxy-2'-fluoro
  misc_feature (8)..(8): 2'-deoxy
  misc_feature (9)..(10): 2'-deoxy-2'-fluoro
  misc_feature (11)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
gcuguuuauugaaagaguctt

SEQ ID NO: 3152 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(3): 2'-deoxy
  misc_feature (4)..(6): 2'-deoxy-2'-fluoro
  misc_feature (7)..(7): 2'-deoxy
  misc_feature (8)..(9): 2'-deoxy-2'-fluoro
  misc_feature (10)..(16): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
cuguuuauugaaagagucatt

SEQ ID NO: 3153 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(5): 2'-deoxy-2'-fluoro
  misc_feature (6)..(6): 2'-deoxy
  misc_feature (7)..(8): 2'-deoxy-2'-fluoro
  misc_feature (9)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
uguuuauugaaagagucactt

SEQ ID NO: 3154 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(4): 2'-deoxy-2'-fluoro
  misc_feature (5)..(5): 2'-deoxy
  misc_feature (6)..(7): 2'-deoxy-2'-fluoro
  misc_feature (8)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
guuuauugaaagagucacatt

SEQ ID NO: 3155 - DNA, 21 bp, Artificial Sequence
  Description of Artificial Sequence:  synthetic
  misc_feature (1)..(3): 2'-deoxy-2'-fluoro
  misc_feature (1)..(1): 5'-3 attached terminal deoxyabasic moeity
  misc_feature (4)..(4): 2'-deoxy
  misc_feature (5)..(6): 2'-deoxy-2'-fluoro
  misc_feature (7)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
uuuauugaaagagucacagtt

SEQ ID NO: 3156 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(6): 2'-deoxy
  misc_feature (7)..(7): 2'-deoxy-2'-fluoro
  misc_feature (8)..(10): 2'-deoxy
  misc_feature (11)..(11): 2'-deoxy-2'-fluoro
  misc_feature (12)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
ugccagcaagugggaguuutt

SEQ ID NO: 3157 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ccagcaagugggaguuugctt

SEQ ID NO: 3158 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(6): 2'-deoxy-2'-fluoro
  misc_feature (7)..(8): 2'-deoxy
  misc_feature (9)..(9): 2'-deoxy-2'-fluoro
  misc_feature (10)..(10): 2'-deoxy
  misc_feature (11)..(12): 2'-deoxy-2'-fluoro
  misc_feature (13)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gcauuuggcauuaagaaautt

SEQ ID NO: 3159 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(5): 2'-deoxy-2'-fluoro
  misc_feature (6)..(7): 2'-deoxy
  misc_feature (8)..(8): 2'-deoxy-2'-fluoro
  misc_feature (9)..(9): 2'-deoxy
  misc_feature (10)..(11): 2'-deoxy-2'-fluoro
  misc_feature (12)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cauuuggcauuaagaaauctt

SEQ ID NO: 3160 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(9): 2'-deoxy-2'-fluoro
  misc_feature (10)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
uuuggcauuaagaaaucactt

SEQ ID NO: 3161 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
uuggcauuaagaaaucacctt

SEQ ID NO: 3162 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(7): 2'-deoxy
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ugccggacuguggcugugatt

SEQ ID NO: 3163 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(10): 2'-deoxy
  misc_feature (11)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
gaguacaaagcucugaugatt

SEQ ID NO: 3164 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(13): 2'-deoxy-2'-fluoro
  misc_feature (14)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aguacaaagcucugaugactt

SEQ ID NO: 3165 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(12): 2'-deoxy
  misc_feature (13)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
aagcaaggagggccucugatt

SEQ ID NO: 3166 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(9): 2'-deoxy
  misc_feature (10)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
caaggagggccucugauggtt

SEQ ID NO: 3167 - DNA, 21 bp, Artificial Sequence
  Description of Artificial Sequence:  synthetic
  misc_feature (1)..(7): 2'-deoxy
  misc_feature (1)..(1): 5'-3 attached terminal deoxyabasic moeity
  misc_feature (8)..(12): 2'-deoxy-2'-fluoro
  misc_feature (13)..(14): 2'-deoxy
  misc_feature (15)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aggagggccucugauggugtt

SEQ ID NO: 3168 - DNA, 21 bp, Artificial Sequence
  Description of Artificial Sequence:  synthetic
  misc_feature (1)..(1): 5'-3 attached terminal deoxyabasic moeity
  misc_feature (1)..(6): 2'-deoxy
  misc_feature (7)..(11): 2'-deoxy-2'-fluoro
  misc_feature (12)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ggagggccucugauggugatt

SEQ ID NO: 3169 - DNA, 21 bp, Artificial Sequence
  Description of Artificial Sequence:  synthetic
  misc_feature (1)..(5): 2'-deoxy
  misc_feature (1)..(1): 5'-3 attached terminal deoxyabasic moeity
  misc_feature (6)..(10): 2'-deoxy-2'-fluoro
  misc_feature (11)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gagggccucugauggugautt

SEQ ID NO: 3170 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(7): 2'-deoxy
  misc_feature (8)..(9): 2'-deoxy-2'-fluoro
  misc_feature (10)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
caaguggccagaggcauggtt

SEQ ID NO: 3171 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(6): 2'-deoxy
  misc_feature (7)..(8): 2'-deoxy-2'-fluoro
  misc_feature (9)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
aaguggccagaggcauggatt

SEQ ID NO: 3172 - DNA, 21 bp, Artificial Sequence
  Description of Artificial Sequence:  synthetic
  misc_feature (1)..(19): ribonucleotide modified as described
uggccagaggcauggaguutt

SEQ ID NO: 3173 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(4): 2'-deoxy-2'-fluoro
  misc_feature (5)..(12): 2'-deoxy
  misc_feature (13)..(14): 2'-deoxy-2'-fluoro
  misc_feature (15)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gccuggaaagaaucaaaactt

SEQ ID NO: 3174 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy-2'-fluoro
  misc_feature (5)..(6): 2'-deoxy
  misc_feature (7)..(8): 2'-deoxy-2'-fluoro
  misc_feature (9)..(10): 2'-deoxy
  misc_feature (11)..(11): 2'-deoxy-2'-fluoro
  misc_feature (12)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
uuuugacuaacaagaaugutt

SEQ ID NO: 3175 - DNA, 21 bp, Artificial Sequence
  Description of Artificial Sequence:  synthetic
  misc_feature (4)..(8): 2'-deoxy-2'-fluoro
  misc_feature (9)..(11): 2'-O-methyl
  misc_feature (12)..(14): 2'-deoxy-2'-fluoro
  misc_feature (15)..(16): 2'-O-methyl
  misc_feature (17)..(19): 2'-deoxy-2'-fluoro
  misc_feature (1)..(19): ribonucleotide modified as described
ugccuuuuaaacucaguuctt

SEQ ID NO: 3176 - DNA, 21 bp, Artificial Sequence
  Description of Artificial Sequence:  synthetic
  misc_feature (4)..(9): 2'-deoxy-2'-fluoro
  misc_feature (10)..(12): 2'-O-methyl
  misc_feature (13)..(15): 2'-deoxy-2'-fluoro
  misc_feature (16)..(17): 2'-O-methyl
  misc_feature (18)..(19): 2'-deoxy-2'-fluoro
  misc_feature (1)..(19): ribonucleotide modified as described
gugccuuuuaaacucaguutt

SEQ ID NO: 3177 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(14): 2'-O-methyl
  misc_feature (15)..(17): 2'-deoxy-2'-fluoro
  misc_feature (18)..(19): 2'-O-methyl
  misc_feature (1)..(19): ribonucleotide modified as described
gggugccuuuuaaacucagtt

SEQ ID NO: 3178 - DNA, 21 bp, Artificial Sequence
  Description of Artificial Sequence:  synthetic
  misc_feature (6)..(6): 2'-deoxy-2'-fluoro
  misc_feature (8)..(13): 2'-deoxy-2'-fluoro
  misc_feature (17)..(19): 2'-deoxy-2'-fluoro
  misc_feature (1)..(19): ribonucleotide modified as described
cugggugccuuuuaaacuctt

SEQ ID NO: 3179 - DNA, 21 bp, Artificial Sequence
  Description of Artificial Sequence:  synthetic
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(9): 2'-O-methyl
  misc_feature (10)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
ugcugggugccuuuuaaactt

SEQ ID NO: 3180 - DNA, 21 bp, Artificial Sequence
  Description of Artificial Sequence:  synthetic
  misc_feature (4)..(7): 2'-deoxy-2'-fluoro
  misc_feature (8)..(10): 2'-O-methyl
  misc_feature (11)..(19): 2'-deoxy-2'-fluoro
  misc_feature (1)..(19): ribonucleotide modified as described
caguuucagguccucuccutt

SEQ ID NO: 3181 - DNA, 21 bp, Artificial Sequence
  Description of Artificial Sequence:  synthetic
  misc_feature (4)..(4): 2'-O-methyl
  misc_feature (5)..(8): 2'-deoxy-2'-fluoro
  misc_feature (9)..(11): 2'-O-methyl
  misc_feature (12)..(19): 2'-deoxy-2'-fluoro
  misc_feature (1)..(19): ribonucleotide modified as described
acaguuucagguccucucctt

SEQ ID NO: 3182 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
guuguauuuugugguuguutt

SEQ ID NO: 3183 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
uuguuguauuuugugguugtt

SEQ ID NO: 3184 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
ucuuguuguauuuuguggutt

SEQ ID NO: 3185 - DNA, 21 bp, Artificial Sequence
  Description of Artificial Sequence:  synthetic
  misc_feature (4)..(4): 2'-O-methyl
  misc_feature (5)..(8): 2'-deoxy-2'-fluoro
  misc_feature (9)..(12): 2'-O-methyl
  misc_feature (13)..(13): 2'-deoxy-2'-fluoro
  misc_feature (14)..(15): 2'-O-methyl
  misc_feature (16)..(19): 2'-deoxy-2'-fluoro
  misc_feature (1)..(19): ribonucleotide modified as described
cugguccuaaaauaauucctt

SEQ ID NO: 3186 - DNA, 21 bp, Artificial Sequence
  Description of Artificial Sequence:  synthetic
  misc_feature (4)..(6): 2'-deoxy-2'-fluoro
  misc_feature (7)..(8): 2'-O-methyl
  misc_feature (9)..(9): 2'-deoxy-2'-fluoro
  misc_feature (10)..(12): 2'-O-methyl
  misc_feature (13)..(13): 2'-deoxy-2'-fluoro
  misc_feature (14)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
ucuuucaauaaacagcgugtt

SEQ ID NO: 3187 - DNA, 21 bp, Artificial Sequence
  Description of Artificial Sequence:  synthetic
  misc_feature (4)..(7): 2'-deoxy-2'-fluoro
  misc_feature (8)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
cucuuucaauaaacagcgutt

SEQ ID NO: 3188 - DNA, 21 bp, Artificial Sequence
  Description of Artificial Sequence:  synthetic
  misc_feature (4)..(8): 2'-deoxy-2'-fluoro
  misc_feature (9)..(10): 2'-O-methyl
  misc_feature (11)..(11): 2'-deoxy-2'-fluoro
  misc_feature (12)..(14): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
acucuuucaauaaacagcgtt

SEQ ID NO: 3189 - DNA, 21 bp, Artificial Sequence
  Description of Artificial Sequence:  synthetic
  misc_feature (4)..(9): 2'-deoxy-2'-fluoro
  misc_feature (10)..(11): 2'-O-methyl
  misc_feature (12)..(12): 2'-deoxy-2'-fluoro
  misc_feature (13)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
gacucuuucaauaaacagctt

SEQ ID NO: 3190 - DNA, 21 bp, Artificial Sequence
  Description of Artificial Sequence:  synthetic
  misc_feature (4)..(10): 2'-deoxy-2'-fluoro
  misc_feature (11)..(12): 2'-O-methyl
  misc_feature (13)..(13): 2'-deoxy-2'-fluoro
  misc_feature (14)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
ugacucuuucaauaaacagtt

SEQ ID NO: 3191 - DNA, 21 bp, Artificial Sequence
  Description of Artificial Sequence:  synthetic
  misc_feature (4)..(4): 2'-O-methyl
  misc_feature (5)..(11): 2'-deoxy-2'-fluoro
  misc_feature (12)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
gugacucuuucaauaaacatt

SEQ ID NO: 3192 - DNA, 21 bp, Artificial Sequence
  Description of Artificial Sequence:  synthetic
  misc_feature (4)..(5): 2'-O-methyl
  misc_feature (6)..(12): 2'-deoxy-2'-fluoro
  misc_feature (13)..(14): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
ugugacucuuucaauaaactt

SEQ ID NO: 3193 - DNA, 21 bp, Artificial Sequence
  Description of Artificial Sequence:  synthetic
  misc_feature (4)..(4): 2'-deoxy-2'-fluoro
  misc_feature (5)..(6): 2'-O-methyl
  misc_feature (7)..(13): 2'-deoxy-2'-fluoro
  misc_feature (14)..(15): 2'-O-methyl
  misc_feature (16)..(16): 2'-deoxy-2'-fluoro
  misc_feature (17)..(19): 2'-O-methyl
  misc_feature (1)..(19): ribonucleotide modified as described
cugugacucuuucaauaaatt

SEQ ID NO: 3194 - DNA, 21 bp, Artificial Sequence
  Description of Artificial Sequence:  synthetic
  misc_feature (4)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (14)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
aaacucccacuugcuggcatt

SEQ ID NO: 3195 - DNA, 21 bp, Artificial Sequence
  Description of Artificial Sequence:  synthetic
  misc_feature (4)..(5): 2'-O-methyl
  misc_feature (6)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(17): 2'-deoxy-2'-fluoro
  misc_feature (18)..(19): 2'-O-methyl
  misc_feature (1)..(19): ribonucleotide modified as described
gcaaacucccacuugcuggtt

SEQ ID NO: 3196 - DNA, 21 bp, Artificial Sequence
  Description of Artificial Sequence:  synthetic
  misc_feature (4)..(7): 2'-deoxy-2'-fluoro
  misc_feature (8)..(9): 2'-O-methyl
  misc_feature (10)..(10): 2'-deoxy-2'-fluoro
  misc_feature (11)..(11): 2'-O-methyl
  misc_feature (12)..(13): 2'-deoxy-2'-fluoro
  misc_feature (14)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
auuucuuaaugccaaaugctt

SEQ ID NO: 3197 - DNA, 21 bp, Artificial Sequence
  Description of Artificial Sequence:  synthetic
  misc_feature (4)..(8): 2'-deoxy-2'-fluoro
  misc_feature (9)..(10): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
gauuucuuaaugccaaaugtt

SEQ ID NO: 3198 - DNA, 21 bp, Artificial Sequence
  Description of Artificial Sequence:  synthetic
  misc_feature (4)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
ugauuucuuaaugccaaautt

SEQ ID NO: 3199 - DNA, 21 bp, Artificial Sequence
  Description of Artificial Sequence:  synthetic
  misc_feature (5)..(10): 2'-deoxy-2'-fluoro
  misc_feature (13)..(13): 2'-deoxy-2'-fluoro
  misc_feature (15)..(16): 2'-deoxy-2'-fluoro
  misc_feature (1)..(19): ribonucleotide modified as described
gugauuucuuaaugccaaatt

SEQ ID NO: 3200 - DNA, 21 bp, Artificial Sequence
  Description of Artificial Sequence:  synthetic
  misc_feature (4)..(5): 2'-O-methyl
  misc_feature (6)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(19): 2'-O-methyl
  misc_feature (1)..(19): ribonucleotide modified as described
ggugauuucuuaaugccaatt

SEQ ID NO: 3201 - DNA, 21 bp, Artificial Sequence
  Description of Artificial Sequence:  synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
ucacagccacaguccggcatt

SEQ ID NO: 3202 - DNA, 21 bp, Artificial Sequence
  Description of Artificial Sequence:  synthetic
  misc_feature (4)..(5): 2'-deoxy-2'-fluoro
  misc_feature (6)..(9): 2'-O-methyl
  misc_feature (10)..(13): 2'-deoxy-2'-fluoro
  misc_feature (14)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
ucaucagagcuuuguacuctt

SEQ ID NO: 3203 - DNA, 21 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
gucaucagagcuuuguacutt

SEQ ID NO: 3204 - DNA, 21 bp, Artificial Sequence
  Description of Artificial Sequence:  synthetic
  misc_feature (4)..(7): 2'-O-methyl
  misc_feature (8)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
ucagaggcccuccuugcuutt

SEQ ID NO: 3205 - DNA, 21 bp, Artificial Sequence
  Description of Artificial Sequence:  synthetic
  misc_feature (4)..(4): 2'-deoxy-2'-fluoro
  misc_feature (5)..(9): 2'-O-methyl
  misc_feature (10)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
caucagaggcccuccuugctt

SEQ ID NO: 3206 - DNA, 21 bp, Artificial Sequence
  Description of Artificial Sequence:  synthetic
  misc_feature (4)..(5): 2'-deoxy-2'-fluoro
  misc_feature (6)..(10): 2'-O-methyl
  misc_feature (11)..(18): 2'-deoxy-2'-fluoro
  misc_feature (19)..(19): 2'-O-methyl
  misc_feature (1)..(19): ribonucleotide modified as described
ccaucagaggcccuccuugtt

SEQ ID NO: 3207 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(12): 2'-O-methyl
  misc_feature (13)..(19): 2'-deoxy-2'-fluoro
  misc_feature (1)..(19): ribonucleotide modified as described
caccaucagaggcccuccutt

SEQ ID NO: 3208 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(13): 2'-O-methyl
  misc_feature (14)..(19): 2'-deoxy-2'-fluoro
  misc_feature (1)..(19): ribonucleotide modified as described
ucaccaucagaggcccucctt

SEQ ID NO: 3209 - DNA, 21 bp, Artificial Sequence
  Description of Artificial Sequence:  synthetic
  misc_feature (4)..(4): 2'-O-methyl4
  misc_feature (5)..(6): 2'-deoxy-2'-fluoro
  misc_feature (7)..(7): 2'-O-methyl4
  misc_feature (8)..(9): 2'-deoxy-2'-fluoro
  misc_feature (10)..(14): 2'-O-methyl4
  misc_feature (15)..(19): 2'-deoxy-2'-fluoro
  misc_feature (1)..(19): ribonucleotide modified as described
aucaccaucagaggcccuctt

SEQ ID NO: 3210 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
ccaugccucuggccacuugtt

SEQ ID NO: 3211 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(11): 2'-deoxy-2'-fluoro
  misc_feature (12)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
uccaugccucuggccacuutt

SEQ ID NO: 3212 - DNA, 21 bp, Artificial Sequence
  Description of Artificial Sequence:  synthetic
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
aacuccaugccucuggccatt

SEQ ID NO: 3213 - DNA, 21 bp, Artificial Sequence
  Description of Artificial Sequence:  synthetic
  misc_feature (4)..(5): 2'-deoxy-2'-fluoro
  misc_feature (6)..(7): 2'-O-methyl
  misc_feature (8)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
guuuugauucuuuccaggctt

SEQ ID NO: 3214 - DNA, 21 bp, Artificial Sequence
  Description of Artificial Sequence:  synthetic
  misc_feature (4)..(8): 2'-deoxy-2'-fluoro
  misc_feature (9)..(9): 2'-O-methyl
  misc_feature (10)..(11): 2'-deoxy-2'-fluoro
  misc_feature (12)..(13): 2'-O-methyl
  misc_feature (14)..(15): 2'-deoxy-2'-fluoro
  misc_feature (16)..(19): 2'-O-methyl
  misc_feature (1)..(19): ribonucleotide modified as described
acauucuuguuagucaaaatt

SEQ ID NO: 3215 - DNA, 21 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
ugugccagcaguccagcautt

SEQ ID NO: 3216 - DNA, 21 bp, Artificial Sequence
  Description of Artificial Sequence:  synthetic
  misc_feature (2)..(2): inverted deoxyabasic moeity
  misc_feature (1)..(19): ribonucleotide modified as described
  misc_feature (21)..(21): 3'-3 attached terminal deoxyabasic moeity
cugaguuuaaaaggcaccctt

SEQ ID NO: 3217 - DNA, 21 bp, Artificial Sequence
  Description of Artificial Sequence:  synthetic
  misc_feature (2)..(5): 2'-deoxy-2'-Fluoro
  misc_feature (10)..(10): 2'-deoxy-2'-Fluoro
  misc_feature (12)..(15): 2'-deoxy-2'-Fluoro
  misc_feature (17)..(19): 2'-deoxy-2'-Fluoro
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
accuuggagcaucucaucutt

SEQ ID NO: 3218 - DNA, 21 bp, Artificial Sequence
  Description of Artificial Sequence:  synthetic
  misc_feature (1)..(1): 5'-3 attached terminal deoxyabasic moeity
  misc_feature (2)..(4): 2'-deoxy-2'-fluoro
  misc_feature (6)..(11): 2'-deoxy-2'-fluoro
  misc_feature (13)..(13): 2'-deoxy-2'-fluoro
  misc_feature (15)..(15): 2'-deoxy-2'-fluoro
  misc_feature (1)..(19): ribonucleotide modified as described
  misc_feature (21)..(21): 3'-3 attached terminal deoxyabasic moeity
accuguuuccuguauggagtt

SEQ ID NO: 3219 - DNA, 21 bp, Artificial Sequence
  Description of Artificial Sequence:  synthetic
  misc_feature (4)..(4): 2'-deoxy-2'-fluoro
  misc_feature (9)..(9): 2'-deoxy-2'-fluoro
  misc_feature (11)..(14): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
agaugagaugcuccaaggutt

SEQ ID NO: 3220 - DNA, 21 bp, Artificial Sequence
  Description of Artificial Sequence:  synthetic
  misc_feature (1)..(4): 2'-deoxy-2'-fluoro
  misc_feature (6)..(6): 2'-deoxy-2'-fluoro
  misc_feature (8)..(8): 2'-deoxy-2'-fluoro
  misc_feature (15)..(15): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
cuccauacaggaaacaggutt

SEQ ID NO: 3221 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(5): 2'-deoxy-2'-fluoro
  misc_feature (6)..(9): 2'-deoxy
  misc_feature (10)..(10): 2'-deoxy-2'-fluoro
  misc_feature (11)..(11): 2'-deoxy
  misc_feature (12)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
accuuggagcaucucaucutt

SEQ ID NO: 3222 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(4): 2'-deoxy-2'-fluoro
  misc_feature (5)..(5): 2'-deoxy
  misc_feature (6)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (1)..(19): ribonucleotide modified as described
  misc_feature (21)..(21): 3'-3 attached terminal deoxyabasic moeity
accuguuuccuguauggagtt

SEQ ID NO: 3223 - DNA, 21 bp, Artificial Sequence
  Description of Artificial Sequence:  synthetic
  misc_feature (1)..(3): 2'-deoxy
  misc_feature (4)..(4): 2'-deoxy-2'-fluoro
  misc_feature (5)..(8): 2'-deoxy
  misc_feature (9)..(9): 2'-deoxy-2'-fluoro
  misc_feature (10)..(10): 2'-deoxy
  misc_feature (11)..(14): 2'-deoxy-2'-fluoro
  misc_feature (15)..(18): 2'-deoxy
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
agaugagaugcuccaaggutt

SEQ ID NO: 3224 - DNA, 21 bp, Artificial Sequence
  Description of Artificial Sequence:  synthetic
  misc_feature (1)..(3): 2'-deoxy
  misc_feature (4)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (1)..(19): ribonucleotide modified as described
  misc_feature (20)..(20): Phosphorothioate 3'-Internucleotide Linkage
gaauccucuuccaugcucatt

SEQ ID NO: 3225 - DNA, 21 bp, Artificial Sequence
  Description of Artificial Sequence:  synthetic
  misc_feature (1)..(4): 2'-deoxy-2'-fluoro
  misc_feature (5)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
cuccauacaggaaacaggutt

SEQ ID NO: 3226 - DNA, 21 bp, Artificial Sequence
  Description of Artificial Sequence:  synthetic
  misc_feature (1)..(1): 2'-deoxy
  misc_feature (2)..(3): 2'-deoxy-2'-fluoro
  misc_feature (4)..(5): 2'-deoxy
  misc_feature (6)..(10): 2'-deoxy-2'-fluoro
  misc_feature (11)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (20)..(20): Phosphorothioate 3'-Internucleotide Linkage
acugauuccugcuguguugtt

SEQ ID NO: 3227 - DNA, 21 bp, Artificial Sequence
  Description of Artificial Sequence:  synthetic
  misc_feature (1)..(3): 2'-deoxy-2'-fluoro
  misc_feature (1)..(1): 5'-3 attached terminal deoxyabasic moeity
  misc_feature (5)..(7): 2'-deoxy-2'-fluoro
  misc_feature (9)..(11): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
uccacuuaccugaggagcatt

SEQ ID NO: 3228 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (5)..(5): 2'-deoxy-2'-fluoro
  misc_feature (7)..(7): 2'-deoxy-2'-fluoro
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
ugagcauggaagaggauuctt

SEQ ID NO: 3229 - DNA, 21 bp, Artificial Sequence
  Description of Artificial Sequence:  synthetic
  misc_feature (1)..(1): 5'-3 attached terminal deoxyabasic moeity
  misc_feature (3)..(7): 2'-deoxy-2'-fluoro
  misc_feature (9)..(12): 2'-deoxy-2'-fluoro
  misc_feature (1)..(19): ribonucleotide modified as described
  misc_feature (21)..(21): 3'-3 attached terminal deoxyabasic moeity
gguucuugccucagaagagtt

SEQ ID NO: 3230 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (7)..(9): 2'-deoxy-2'-fluoro
  misc_feature (13)..(14): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
ugaaggcucaaaccagacatt

SEQ ID NO: 3231 - DNA, 21 bp, Artificial Sequence
  Description of Artificial Sequence:  synthetic
  misc_feature (1)..(1): 2'-deoxy-2'-fluoro
  misc_feature (3)..(8): 2'-deoxy-2'-fluoro
  misc_feature (12)..(12): 2'-deoxy-2'-fluoro
  misc_feature (16)..(16): 2'-deoxy-2'-fluoro
  misc_feature (1)..(19): ribonucleotide modified as described
  misc_feature (20)..(20): Phosphorothioate 3'-Internucleotide Linkage
ugcuccucagguaaguggatt

SEQ ID NO: 3232 - DNA, 21 bp, Artificial Sequence
  Description of Artificial Sequence:  synthetic
  misc_feature (4)..(12): 2'-deoxy-2'-fluoro
  misc_feature (14)..(14): 2'-deoxy-2'-fluoro
  misc_feature (16)..(18): 2'-deoxy-2'-fluoro
  misc_feature (1)..(19): ribonucleotide modified as described
  misc_feature (20)..(20): Phosphorothioate 3'-Internucleotide Linkage
gaauccucuuccaugcucatt

SEQ ID NO: 3233 - DNA, 21 bp, Artificial Sequence
  Description of Artificial Sequence:  synthetic
  misc_feature (1)..(7): 2'-deoxy-2'-fluoro
  misc_feature (12)..(12): 2'-deoxy-2'-fluoro
  misc_feature (18)..(19): 2'-deoxy-2'-fluoro
  misc_feature (1)..(19): ribonucleotide modified as described
  misc_feature (20)..(20): Phosphorothioate 3'-Internucleotide Linkage
cucuucugaggcaagaacctt

SEQ ID NO: 3234 - DNA, 21 bp, Artificial Sequence
  Description of Artificial Sequence:  synthetic
  misc_feature (1)..(1): 2'-deoxy-2'-fluoro
  misc_feature (3)..(5): 2'-deoxy-2'-fluoro
  misc_feature (8)..(10): 2'-deoxy-2'-fluoro
  misc_feature (14)..(18): 2'-deoxy-2'-fluoro
  misc_feature (1)..(19): ribonucleotide modified as described
  misc_feature (20)..(20): Phosphorothioate 3'-Internucleotide Linkage
ugucugguuugagccuucatt

SEQ ID NO: 3235 - DNA, 21 bp, Artificial Sequence
  Description of Artificial Sequence:  synthetic
  misc_feature (1)..(19): ribonucleotide modified as described
uccacuuaccugaggagcatt

SEQ ID NO: 3236 - DNA, 21 bp, Artificial Sequence
  Description of Artificial Sequence:  synthetic
  misc_feature (1)..(19): ribonucleotide modified as described
ugagcauggaagaggauuctt

SEQ ID NO: 3237 - DNA, 21 bp, Artificial Sequence
  Description of Artificial Sequence:  synthetic
  misc_feature (1)..(19): ribonucleotide modified as described
gguucuugccucagaagagtt

SEQ ID NO: 3238 - DNA, 21 bp, Artificial Sequence
  Description of Artificial Sequence:  synthetic
  misc_feature (1)..(19): ribonucleotide modified as described
ugaaggcucaaaccagacatt

SEQ ID NO: 3239 - DNA, 21 bp, Artificial Sequence
  Description of Artificial Sequence:  synthetic
  misc_feature (1)..(19): ribonucleotide modified as described
ugcuccucagguaaguggatt

SEQ ID NO: 3240 - DNA, 21 bp, Artificial Sequence
  Description of Artificial Sequence:  synthetic
  misc_feature (1)..(19): ribonucleotide modified as described
gaauccucuuccaugcucatt

SEQ ID NO: 3241 - DNA, 21 bp, Artificial Sequence
  Description of Artificial Sequence:  synthetic
  misc_feature (1)..(19): ribonucleotide modified as described
cucuucugaggcaagaacctt

SEQ ID NO: 3242 - DNA, 21 bp, Artificial Sequence
  Description of Artificial Sequence:  synthetic
  misc_feature (1)..(19): ribonucleotide modified as described
ugucugguuugagccuucatt

SEQ ID NO: 3243 - DNA, 21 bp, Artificial Sequence
  Description of Artificial Sequence:  synthetic
  misc_feature (1)..(19): ribonucleotide modified as described
accuuggagcaucucaucutt

SEQ ID NO: 3244 - DNA, 21 bp, Artificial Sequence
  Description of Artificial Sequence:  synthetic
  misc_feature (1)..(19): ribonucleotide modified as described
accuguuuccuguauggagtt

SEQ ID NO: 3245 - DNA, 21 bp, Artificial Sequence
  Description of Artificial Sequence:  synthetic
  misc_feature (1)..(19): ribonucleotide modified as described
caacacagcaggaaucagutt

SEQ ID NO: 3246 - DNA, 21 bp, Artificial Sequence
  Description of Artificial Sequence:  synthetic
  misc_feature (1)..(19): ribonucleotide modified as described
agaugagaugcuccaaggutt

SEQ ID NO: 3247 - DNA, 21 bp, Artificial Sequence
  Description of Artificial Sequence:  synthetic
  misc_feature (1)..(19): ribonucleotide modified as described
cuccauacaggaaacaggutt

SEQ ID NO: 3248 - DNA, 21 bp, Artificial Sequence
  Description of Artificial Sequence:  synthetic
  misc_feature (1)..(19): ribonucleotide modified as described
acugauuccugcuguguugtt

SEQ ID NO: 3249 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (4)..(4): 2'-deoxy-2'-fluoro
  misc_feature (6)..(6): 2'-deoxy-2'-fluoro
  misc_feature (9)..(9): 2'-deoxy-2'-fluoro
  misc_feature (15)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
caacacagcaggaaucagutt

SEQ ID NO: 3250 - DNA, 21 bp, Artificial Sequence
  Description of Artificial Sequence:  synthetic
  misc_feature (2)..(3): 2'-deoxy-2'-fluoro
  misc_feature (6)..(10): 2'-deoxy-2'-fluoro
  misc_feature (12)..(13): 2'-deoxy-2'-fluoro
  misc_feature (15)..(15): 2'-deoxy-2'-fluoro
  misc_feature (17)..(18): 2'-deoxy-2'-fluoro
  misc_feature (1)..(19): ribonucleotide modified as described
  misc_feature (20)..(20): Phosphorothioate 3'-Internucleotide Linkage
acugauuccugcuguguugtt

SEQ ID NO: 3251 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
ugagcauggaagaggauuctt

SEQ ID NO: 3252 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(3): 2'-deoxy
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(8): 2'-deoxy
  misc_feature (9)..(9): 2'-deoxy-2'-fluoro
  misc_feature (10)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
caacacagcaggaaucagutt

SEQ ID NO: 3253 - DNA, 21 bp, Artificial Sequence
  Description of Artificial Sequence:  synthetic
  misc_feature (4)..(12): 2'-deoxy-2'-fluoro
  misc_feature (14)..(14): 2'-deoxy-2'-fluoro
  misc_feature (16)..(18): 2'-deoxy-2'-fluoro
  misc_feature (1)..(19): ribonucleotide modified as described
  misc_feature (20)..(20): Phosphorothioate 3'-Internucleotide Linkage
gaauccucuuccaugcucatt

SEQ ID NO: 3254 - DNA, 21 bp, Artificial Sequence
  Description of Artificial Sequence:  synthetic
  misc_feature (2)..(3): 2'-deoxy-2'-fluoro
  misc_feature (6)..(10): 2'-deoxy-2'-fluoro
  misc_feature (12)..(13): 2'-deoxy-2'-fluoro
  misc_feature (15)..(15): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (1)..(19): ribonucleotide modified as described
acugauuccugcuguguugtt

SEQ ID NO: 3255 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
ugagcauggaagaggauuctt

SEQ ID NO: 3256 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
caacacagcaggaaucagutt

SEQ ID NO: 3257 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gaauccucuuccaugcucatt

SEQ ID NO: 3258 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acugauuccugcuguguugtt

SEQ ID NO: 3259 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (13)..(13): 2'-deoxy-2'-fluoro
  misc_feature (15)..(15): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cuuaggagaagguacgagutt

SEQ ID NO: 3260 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (4)..(5): 2'-deoxy-2'-fluoro
  misc_feature (11)..(11): 2'-deoxy-2'-fluoro
  misc_feature (14)..(14): 2'-deoxy-2'-fluoro
  misc_feature (16)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ugacuaaggacgacacaactt

SEQ ID NO: 3261 - DNA, 21 bp, Artificial Sequence
  Description of Artificial Sequence:  synthetic
  misc_feature (2)..(4): 2'-deoxy-2'-fluoro
  misc_feature (6)..(6): 2'-deoxy-2'-fluoro
  misc_feature (8)..(16): 2'-deoxy-2'-fluoro
  misc_feature (1)..(19): ribonucleotide modified as described
  misc_feature (20)..(20): Phosphorothioate 3'-Internucleotide Linkage
acucguaccuucuccuaagtt

SEQ ID NO: 3262 - DNA, 21 bp, Artificial Sequence
  Description of Artificial Sequence:  synthetic
  misc_feature (2)..(3): 2'-deoxy-2'-fluoro
  misc_feature (5)..(5): 2'-deoxy-2'-fluoro
  misc_feature (7)..(8): 2'-deoxy-2'-fluoro
  misc_feature (10)..(14): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (1)..(19): ribonucleotide modified as described
guugugucguccuuagucatt

SEQ ID NO: 3263 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (13)..(13): 2'-deoxy-2'-fluoro
  misc_feature (15)..(15): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cuuaggagaagguacgagutt

SEQ ID NO: 3264 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (4)..(5): 2'-deoxy-2'-fluoro
  misc_feature (11)..(11): 2'-deoxy-2'-fluoro
  misc_feature (14)..(14): 2'-deoxy-2'-fluoro
  misc_feature (16)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ugacuaaggacgacacaactt

SEQ ID NO: 3265 - DNA, 21 bp, Artificial Sequence
  Description of Artificial Sequence:  synthetic
  misc_feature (2)..(4): 2'-deoxy-2'-fluoro
  misc_feature (6)..(6): 2'-deoxy-2'-fluoro
  misc_feature (8)..(16): 2'-deoxy-2'-fluoro
  misc_feature (1)..(19): ribonucleotide modified as described
  misc_feature (20)..(20): Phosphorothioate 3'-Internucleotide Linkage
acucguaccuucuccuaagtt

SEQ ID NO: 3266 - DNA, 21 bp, Artificial Sequence
  Description of Artificial Sequence:  synthetic
  misc_feature (2)..(3): 2'-deoxy-2'-fluoro
  misc_feature (5)..(5): 2'-deoxy-2'-fluoro
  misc_feature (7)..(8): 2'-deoxy-2'-fluoro
  misc_feature (10)..(14): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (1)..(19): ribonucleotide modified as described
guugugucguccuuagucatt

SEQ ID NO: 3267 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cuuaggagaagguacgagutt

SEQ ID NO: 3268 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ugacuaaggacgacacaactt

SEQ ID NO: 3269 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acucguaccuucuccuaagtt

SEQ ID NO: 3270 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
guugugucguccuuagucatt

SEQ ID NO: 3271 - DNA, 21 bp, Artificial Sequence
  Description of Artificial Sequence:  synthetic
  misc_feature (1)..(19): ribonucleotide modified as described
ccuuaugaugccagcaaautt

SEQ ID NO: 3272 - DNA, 21 bp, Artificial Sequence
  Description of Artificial Sequence:  synthetic
  misc_feature (1)..(19): ribonucleotide modified as described
cuuaugaugccagcaaaugtt

SEQ ID NO: 3273 - DNA, 21 bp, Artificial Sequence
  Description of Artificial Sequence:  synthetic
  misc_feature (1)..(19): ribonucleotide modified as described
uuaugaugccagcaaauggtt

SEQ ID NO: 3274 - DNA, 21 bp, Artificial Sequence
  Description of Artificial Sequence:  synthetic
  misc_feature (1)..(19): ribonucleotide modified as described
uaugaugccagcaaaugggtt

SEQ ID NO: 3275 - DNA, 21 bp, Artificial Sequence
  Description of Artificial Sequence:  synthetic
  misc_feature (1)..(19): ribonucleotide modified as described
augaugccagcaaaugggatt

SEQ ID NO: 3276 - DNA, 21 bp, Artificial Sequence
  Description of Artificial Sequence:  synthetic
  misc_feature (1)..(19): ribonucleotide modified as described
cagaccaugcuggacugcutt

SEQ ID NO: 3277 - DNA, 21 bp, Artificial Sequence
  Description of Artificial Sequence:  synthetic
  misc_feature (1)..(19): ribonucleotide modified as described
agaccaugcuggacugcugtt

SEQ ID NO: 3278 - DNA, 21 bp, Artificial Sequence
  Description of Artificial Sequence:  synthetic
  misc_feature (1)..(19): ribonucleotide modified as described
gaccaugcuggacugcuggtt

SEQ ID NO: 3279 - DNA, 21 bp, Artificial Sequence
  Description of Artificial Sequence:  synthetic
  misc_feature (1)..(19): ribonucleotide modified as described
accaugcuggacugcuggctt

SEQ ID NO: 3280 - DNA, 21 bp, Artificial Sequence
  Description of Artificial Sequence:  synthetic
  misc_feature (1)..(19): ribonucleotide modified as described
ccaugcuggacugcuggcatt

SEQ ID NO: 3281 - DNA, 21 bp, Artificial Sequence
  Description of Artificial Sequence:  synthetic
  misc_feature (1)..(19): ribonucleotide modified as described
caggauggcaaagacuacatt

SEQ ID NO: 3282 - DNA, 21 bp, Artificial Sequence
  Description of Artificial Sequence:  synthetic
  misc_feature (1)..(19): ribonucleotide modified as described
aggauggcaaagacuacautt

SEQ ID NO: 3283 - DNA, 21 bp, Artificial Sequence
  Description of Artificial Sequence:  synthetic
  misc_feature (1)..(19): ribonucleotide modified as described
auuugcuggcaucauaaggtt

SEQ ID NO: 3284 - DNA, 21 bp, Artificial Sequence
  Description of Artificial Sequence:  synthetic
  misc_feature (1)..(19): ribonucleotide modified as described
cauuugcuggcaucauaagtt

SEQ ID NO: 3285 - DNA, 21 bp, Artificial Sequence
  Description of Artificial Sequence:  synthetic
  misc_feature (1)..(19): ribonucleotide modified as described
ccauuugcuggcaucauaatt

SEQ ID NO: 3286 - DNA, 21 bp, Artificial Sequence
  Description of Artificial Sequence:  synthetic
  misc_feature (1)..(19): ribonucleotide modified as described
cccauuugcuggcaucauatt

SEQ ID NO: 3287 - DNA, 21 bp, Artificial Sequence
  Description of Artificial Sequence:  synthetic
  misc_feature (1)..(19): ribonucleotide modified as described
ucccauuugcuggcaucautt

SEQ ID NO: 3288 - DNA, 21 bp, Artificial Sequence
  Description of Artificial Sequence:  synthetic
  misc_feature (1)..(19): ribonucleotide modified as described
agcaguccagcauggucugtt

SEQ ID NO: 3289 - DNA, 21 bp, Artificial Sequence
  Description of Artificial Sequence:  synthetic
  misc_feature (1)..(19): ribonucleotide modified as described
cagcaguccagcauggucutt

SEQ ID NO: 3290 - DNA, 21 bp, Artificial Sequence
  Description of Artificial Sequence:  synthetic
  misc_feature (1)..(19): ribonucleotide modified as described
ccagcaguccagcaugguctt

SEQ ID NO: 3291 - DNA, 21 bp, Artificial Sequence
  Description of Artificial Sequence:  synthetic
  misc_feature (1)..(19): ribonucleotide modified as described
gccagcaguccagcauggutt

SEQ ID NO: 3292 - DNA, 21 bp, Artificial Sequence
  Description of Artificial Sequence:  synthetic
  misc_feature (1)..(19): ribonucleotide modified as described
ugccagcaguccagcauggtt

SEQ ID NO: 3293 - DNA, 21 bp, Artificial Sequence
  Description of Artificial Sequence:  synthetic
  misc_feature (1)..(19): ribonucleotide modified as described
uguagucuuugccauccugtt

SEQ ID NO: 3294 - DNA, 21 bp, Artificial Sequence
  Description of Artificial Sequence:  synthetic
  misc_feature (1)..(19): ribonucleotide modified as described
auguagucuuugccauccutt

SEQ ID NO: 3295 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
accuuggagcaucucaucutt

SEQ ID NO: 3296 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
accuguuuccuguauggagtt

SEQ ID NO: 3297 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
agaugagaugcuccaaggutt

SEQ ID NO: 3298 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cuccauacaggaaacaggutt

SEQ ID NO: 3299 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ucuacucuacgagguuccatt

SEQ ID NO: 3300 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gagguauguccuuuguccatt

SEQ ID NO: 3301 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uggaaccucguagaguagatt

SEQ ID NO: 3302 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uggacaaaggacauaccuctt

SEQ ID NO: 3303 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (6)..(11): 2'-deoxy-2'-fluoro
  misc_feature (16)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cagaauuuccugggacagctt

SEQ ID NO: 3304 - DNA, 21 bp, Artificial Sequence
  Description of Artificial Sequence:  synthetic
  misc_feature (1)..(1): 5'-3 attached terminal deoxyabasic moeity
  misc_feature (4)..(4): 2'-deoxy-2'-fluoro
  misc_feature (6)..(9): 2'-deoxy-2'-fluoro
  misc_feature (11)..(13): 2'-deoxy-2'-fluoro
  misc_feature (15)..(16): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
gagcaucucaucuguuacatt

SEQ ID NO: 3305 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (3)..(7): 2'-deoxy-2'-fluoro
  misc_feature (12)..(13): 2'-deoxy-2'-fluoro
  misc_feature (16)..(16): 2'-deoxy-2'-fluoro
  misc_feature (1)..(19): ribonucleotide modified as described
  misc_feature (21)..(21): 3'-3 attached terminal deoxyabasic moeity
cguuuucagaguugguggatt

SEQ ID NO: 3306 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (3)..(5): 2'-deoxy-2'-fluoro
  misc_feature (7)..(12): 2'-deoxy-2'-fluoro
  misc_feature (14)..(14): 2'-deoxy-2'-fluoro
  misc_feature (16)..(16): 2'-deoxy-2'-fluoro
  misc_feature (1)..(19): ribonucleotide modified as described
  misc_feature (21)..(21): 3'-3 attached terminal deoxyabasic moeity
caccuguuuccuguauggatt

SEQ ID NO: 3307 - DNA, 21 bp, Artificial Sequence
  Description of Artificial Sequence:  synthetic
  misc_feature (2)..(3): 2'-deoxy-2'-fluoro
  misc_feature (5)..(8): 2'-deoxy-2'-fluoro
  misc_feature (15)..(18): 2'-deoxy-2'-fluoro
  misc_feature (1)..(19): ribonucleotide modified as described
  misc_feature (20)..(20): Phosphorothioate 3'-Internucleotide Linkage
gcugucccaggaaauucugtt

SEQ ID NO: 3308 - DNA, 21 bp, Artificial Sequence
  Description of Artificial Sequence:  synthetic
  misc_feature (1)..(1): 2'-deoxy-2'-fluoro
  misc_feature (3)..(3): 2'-deoxy-2'-fluoro
  misc_feature (6)..(6): 2'-deoxy-2'-fluoro
  misc_feature (10)..(10): 2'-deoxy-2'-fluoro
  misc_feature (15)..(15): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
uguaacagaugagaugcuctt

SEQ ID NO: 3309 - DNA, 21 bp, Artificial Sequence
  Description of Artificial Sequence:  synthetic
  misc_feature (1)..(3): 2'-deoxy-2'-fluoro
  misc_feature (5)..(6): 2'-deoxy-2'-fluoro
  misc_feature (9)..(12): 2'-deoxy-2'-fluoro
  misc_feature (18)..(18): 2'-deoxy-2'-fluoro
  misc_feature (1)..(19): ribonucleotide modified as described
  misc_feature (20)..(20): Phosphorothioate 3'-Internucleotide Linkage
uccaccaacucugaaaacgtt

SEQ ID NO: 3310 - DNA, 21 bp, Artificial Sequence
  Description of Artificial Sequence:  synthetic
  misc_feature (1)..(3): 2'-deoxy-2'-fluoro
  misc_feature (5)..(5): 2'-deoxy-2'-fluoro
  misc_feature (7)..(7): 2'-deoxy-2'-fluoro
  misc_feature (14)..(14): 2'-deoxy-2'-fluoro
  misc_feature (18)..(18): 2'-deoxy-2'-fluoro
  misc_feature (20)..(20): Phosphorothioate 3'-Internucleotide Linkage
  misc_feature (1)..(19): ribonucleotide modified as described
uccauacaggaaacaggugtt

SEQ ID NO: 3311 - DNA, 21 bp, Artificial Sequence
  Description of Artificial Sequence:  synthetic
  misc_feature (1)..(4): 2'-deoxy-2'-fluoro
  misc_feature (6)..(6): 2'-deoxy-2'-fluoro
  misc_feature (8)..(8): 2'-deoxy-2'-fluoro
  misc_feature (15)..(15): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
cuccauacaggaaacaggutt

SEQ ID NO: 3312 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (4)..(4): 2'-deoxy-2'-fluoro
  misc_feature (9)..(14): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cgacaggguccuuuaagactt

SEQ ID NO: 3313 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (4)..(5): 2'-deoxy-2'-fluoro
  misc_feature (7)..(9): 2'-deoxy-2'-fluoro
  misc_feature (11)..(14): 2'-deoxy-2'-fluoro
  misc_feature (16)..(16): 2'-deoxy-2'-fluoro
  misc_feature (1)..(19): ribonucleotide modified as described
  misc_feature (21)..(21): 3'-3 attached terminal deoxyabasic moeity
acauugucuacucuacgagtt

SEQ ID NO: 3314 - DNA, 21 bp, Artificial Sequence
  Description of Artificial Sequence:  synthetic
  misc_feature (1)..(1): 5'-3 attached terminal deoxyabasic moeity
  misc_feature (4)..(4): 2'-deoxy-2'-fluoro
  misc_feature (7)..(8): 2'-deoxy-2'-fluoro
  misc_feature (13)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aggugguugagacuuuugctt

SEQ ID NO: 3315 - DNA, 21 bp, Artificial Sequence
  Description of Artificial Sequence:  synthetic
  misc_feature (1)..(1): 5'-3 attached terminal deoxyabasic moeity
  misc_feature (4)..(4): 2'-deoxy-2'-fluoro
  misc_feature (6)..(6): 2'-deoxy-2'-fluoro
  misc_feature (8)..(13): 2'-deoxy-2'-fluoro
  misc_feature (15)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
agguauguccuuuguccactt

SEQ ID NO: 3316 - DNA, 21 bp, Artificial Sequence
  Description of Artificial Sequence:  synthetic
  misc_feature (1)..(1): 5'-3 attached terminal deoxyabasic moeity
  misc_feature (5)..(5): 2'-deoxy-2'-fluoro
  misc_feature (7)..(7): 2'-deoxy-2'-fluoro
  misc_feature (9)..(14): 2'-deoxy-2'-fluoro
  misc_feature (16)..(18): 2'-deoxy-2'-fluoro
  misc_feature (1)..(19): ribonucleotide modified as described
  misc_feature (21)..(21): 3'-3 attached terminal deoxyabasic moeity
gagguauguccuuuguccatt

SEQ ID NO: 3317 - DNA, 21 bp, Artificial Sequence
  Description of Artificial Sequence:  synthetic
  misc_feature (2)..(5): 2'-deoxy-2'-fluoro
  misc_feature (12)..(15): 2'-deoxy-2'-fluoro
  misc_feature (17)..(18): 2'-deoxy-2'-fluoro
  misc_feature (1)..(19): ribonucleotide modified as described
  misc_feature (20)..(20): Phosphorothioate 3'-Internucleotide Linkage
  misc_feature (20)..(20): Phosphorothioate 3'-Internucleotide Linkage
  misc_feature (1)..(19): ribonucleotide modified as described
gucuuaaaggacccugucgtt

SEQ ID NO: 3318 - DNA, 21 bp, Artificial Sequence
  Description of Artificial Sequence:  synthetic
  misc_feature (1)..(3): 2'-deoxy-2'-fluoro
  misc_feature (5)..(5): 2'-deoxy-2'-fluoro
  misc_feature (10)..(10): 2'-deoxy-2'-fluoro
  misc_feature (14)..(14): 2'-deoxy-2'-fluoro
  misc_feature (17)..(17): 2'-deoxy-2'-fluoro
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
cucguagaguagacaaugutt

SEQ ID NO: 3319 - DNA, 21 bp, Artificial Sequence
  Description of Artificial Sequence:  synthetic
  misc_feature (2)..(2): 2'-deoxy-2'-fluoro
  misc_feature (8)..(11): 2'-deoxy-2'-fluoro
  misc_feature (14)..(15): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
gcaaaagucucaaccaccutt

SEQ ID NO: 3320 - DNA, 21 bp, Artificial Sequence
  Description of Artificial Sequence:  synthetic
  misc_feature (2)..(2): 2'-deoxy-2'-fluoro
  misc_feature (6)..(6): 2'-deoxy-2'-fluoro
  misc_feature (13)..(13): 2'-deoxy-2'-fluoro
  misc_feature (15)..(15): 2'-deoxy-2'-fluoro
  misc_feature (17)..(19): 2'-deoxy-2'-fluoro
  misc_feature (1)..(19): ribonucleotide modified as described
  misc_feature (20)..(20): Phosphorothioate 3'-Internucleotide Linkage
guggacaaaggacauaccutt

SEQ ID NO: 3321 - DNA, 21 bp, Artificial Sequence
  Description of Artificial Sequence:  synthetic
  misc_feature (1)..(1): 2'-deoxy-2'-fluoro
  misc_feature (5)..(5): 2'-deoxy-2'-fluoro
  misc_feature (12)..(12): 2'-deoxy-2'-fluoro
  misc_feature (14)..(14): 2'-deoxy-2'-fluoro
  misc_feature (16)..(19): 2'-deoxy-2'-fluoro
  misc_feature (20)..(20): Phosphorothioate 3'-Internucleotide Linkage
  misc_feature (1)..(19): ribonucleotide modified as described
uggacaaaggacauaccuctt

SEQ ID NO: 3322 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cagaauuuccugggacagctt

SEQ ID NO: 3323 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gagcaucucaucuguuacatt

SEQ ID NO: 3324 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cguuuucagaguugguggatt

SEQ ID NO: 3325 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
caccuguuuccuguauggatt

SEQ ID NO: 3326 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gcugucccaggaaauucugtt

SEQ ID NO: 3327 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uguaacagaugagaugcuctt

SEQ ID NO: 3328 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uccaccaacucugaaaacgtt

SEQ ID NO: 3329 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uccauacaggaaacaggugtt

SEQ ID NO: 3330 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cgacaggguccuuuaagactt

SEQ ID NO: 3331 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acauugucuacucuacgagtt

SEQ ID NO: 3332 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
aggugguugagacuuuugctt

SEQ ID NO: 3333 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
agguauguccuuuguccactt

SEQ ID NO: 3334 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gucuuaaaggacccugucgtt

SEQ ID NO: 3335 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cucguagaguagacaaugutt

SEQ ID NO: 3336 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gcaaaagucucaaccaccutt

SEQ ID NO: 3337 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
guggacaaaggacauaccutt

SEQ ID NO: 3338 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(9): 2'-deoxy-2'-fluoro
  misc_feature (10)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
uaugaugccagcaaaugggtt

SEQ ID NO: 3339 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(10): 2'-deoxy
  misc_feature (11)..(11): 2'-deoxy-2'-fluoro
  misc_feature (12)..(14): 2'-deoxy
  misc_feature (15)..(15): 2'-deoxy-2'-fluoro
  misc_feature (16)..(19): 2'-deoxy
  misc_feature (1)..(19): ribonucleotide modified as described
  misc_feature (21)..(21): 5'-3 attached terminal deoxyabasic moeity
augaugccagcaaaugggatt

SEQ ID NO: 3340 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(11): 2'-deoxy
  misc_feature (12)..(13): 2'-deoxy-2'-fluoro
  misc_feature (14)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
accaugcuggacugcuggctt

SEQ ID NO: 3341 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(10): 2'-deoxy
  misc_feature (11)..(12): 2'-deoxy-2'-fluoro
  misc_feature (13)..(13): 2'-deoxy
  misc_feature (14)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
ccaugcuggacugcuggcatt

SEQ ID NO: 3342 - DNA, 21 bp, Artificial Sequence
  Description of Artificial Sequence:  synthetic
  misc_feature (1)..(3): 2'-deoxy-2'-fluoro
  misc_feature (4)..(4): 2'-O-methyl
  misc_feature (5)..(7): 2'-deoxy-2'-fluoro
  misc_feature (8)..(8): 2'-O-methyl
  misc_feature (9)..(10): 2'-deoxy-2'-fluoro
  misc_feature (11)..(12): 2'-O-methyl
  misc_feature (13)..(13): 2'-deoxy-2'-fluoro
  misc_feature (14)..(14): 2'-O-methyl
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
  misc_feature (20)..(20): Phosphorothioate 3'-Internucleotide Linkage
cccauuugcuggcaucauatt

SEQ ID NO: 3343 - DNA, 21 bp, Artificial Sequence
  Description of Artificial Sequence:  synthetic
  misc_feature (1)..(4): 2'-deoxy-2'-fluoro
  misc_feature (5)..(5): 2'-O-methyl
  misc_feature (6)..(8): 2'-deoxy-2'-fluoro
  misc_feature (9)..(9): 2'-O-methyl
  misc_feature (10)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
ucccauuugcuggcaucautt

SEQ ID NO: 3344 - DNA, 21 bp, Artificial Sequence
  Description of Artificial Sequence:  synthetic
  misc_feature (1)..(1): 2'-O-methyl
  misc_feature (2)..(3): 2'-deoxy-2'-fluoro
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
gccagcaguccagcauggutt

SEQ ID NO: 3345 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(6): 2'-O-methyl
  misc_feature (7)..(7): 2'-deoxy-2'-fluoro
  misc_feature (8)..(9): 2'-O-methyl
  misc_feature (10)..(12): 2'-deoxy-2'-fluoro
  misc_feature (13)..(14): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
  misc_feature (20)..(20): Phosphorothioate 3'-Internucleotide Linkage
ugccagcaguccagcauggtt

SEQ ID NO: 3346 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
uaugaugccagcaaaugggtt

SEQ ID NO: 3347 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
augaugccagcaaaugggatt

SEQ ID NO: 3348 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
accaugcuggacugcuggctt

SEQ ID NO: 3349 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ccaugcuggacugcuggcatt

SEQ ID NO: 3350 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cccauuugcuggcaucauatt

SEQ ID NO: 3351 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ucccauuugcuggcaucautt

SEQ ID NO: 3352 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gccagcaguccagcauggutt

SEQ ID NO: 3353 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugccagcaguccagcauggtt

SEQ ID NO: 3354 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy
  misc_feature (4)..(4): 2'-deoxy-2'-fluoro
  misc_feature (5)..(7): 2'-deoxy
  misc_feature (8)..(8): 2'-deoxy-2'-fluoro
  misc_feature (9)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggguaaacgaccguaguautt

SEQ ID NO: 3355 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aggguaaacgaccguaguatt

SEQ ID NO: 3356 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(6): 2'-deoxy
  misc_feature (7)..(8): 2'-deoxy-2'-fluoro
  misc_feature (9)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(18): 2'-deoxy-2'-fluoro
  misc_feature (1)..(19): ribonucleotide modified as described
  misc_feature (21)..(21): 3'-3 attached terminal deoxyabasic moeity
cggucgucaggucguaccatt

SEQ ID NO: 3357 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(4): 2'-deoxy
  misc_feature (5)..(6): 2'-deoxy-2'-fluoro
  misc_feature (7)..(7): 2'-deoxy
  misc_feature (8)..(9): 2'-deoxy-2'-fluoro
  misc_feature (10)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
acggucgucaggucguacctt

SEQ ID NO: 3358 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(3): 2'-O-methyl
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
  misc_feature (20)..(20): Phosphorothioate 3'-Internucleotide Linkage
auacuacggucguuuaccctt

SEQ ID NO: 3359 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(19): 2'-deoxy-2'-fluoro
  misc_feature (1)..(19): ribonucleotide modified as described
  misc_feature (20)..(20): Phosphorothioate 3'-Internucleotide Linkage
uacuacggucguuuacccutt

SEQ ID NO: 3360 - DNA, 21 bp, Artificial Sequence
  Description of Artificial Sequence:  synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
  misc_feature (20)..(20): Phosphorothioate 3'-Internucleotide Linkage
ugguacgaccugacgaccgtt

SEQ ID NO: 3361 - DNA, 21 bp, Artificial Sequence
  Description of Artificial Sequence:  synthetic
  misc_feature (1)..(2): 2'-O-methyl
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(7): 2'-O-methyl
  misc_feature (8)..(10): 2'-deoxy-2'-fluoro
  misc_feature (11)..(12): 2'-O-methyl
  misc_feature (13)..(13): 2'-deoxy-2'-fluoro
  misc_feature (14)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
gguacgaccugacgaccgutt

SEQ ID NO: 3362 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ggguaaacgaccguaguautt

SEQ ID NO: 3363 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
aggguaaacgaccguaguatt

SEQ ID NO: 3364 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cggucgucaggucguaccatt

SEQ ID NO: 3365 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
acggucgucaggucguacctt

SEQ ID NO: 3366 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
auacuacggucguuuaccctt

SEQ ID NO: 3367 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uacuacggucguuuacccutt

SEQ ID NO: 3368 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ugguacgaccugacgaccgtt

SEQ ID NO: 3369 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gguacgaccugacgaccgutt

SEQ ID NO: 3370 - DNA, 21 bp, Artificial Sequence
  Description of Artificial Sequence:  synthetic
  misc_feature (1)..(1): 2'-O-methyl
  misc_feature (2)..(3): 2'-deoxy-2'-fluoro
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gccagcaguccagcauggutt

SEQ ID NO: 3371 - DNA, 19 bp, Artificial Sequence
  Description of Artificial Sequence:  synthetic
  misc_feature (1)..(1): 2'-O-methyl
  misc_feature (2)..(3): 2'-deoxy-2'-fluoro
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
gccagcaguccagcauggu

SEQ ID NO: 3372 - DNA, 21 bp, Artificial Sequence
  Description of Artificial Sequence:  synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
  misc_feature (21)..(21): 3'-3 attached terminal deoxyabasic moeity
ugguacgaccugacgaccgtt

SEQ ID NO: 3373 - DNA, 19 bp, Artificial Sequence
  Description of Artificial Sequence:  synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(19): 2'-O-methyl
ugguacgaccugacgaccg

SEQ ID NO: 3374 - DNA, 21 bp, Artificial Sequence
  Description of Artificial Sequence:  synthetic
  misc_feature (1)..(19): ribonucleotide modified as described
agaguggcagugagcaaagtt

SEQ ID NO: 3375 - DNA, 21 bp, Artificial Sequence
  Description of Artificial Sequence:  synthetic
  misc_feature (1)..(19): ribonucleotide modified as described
cuuugcucacugccacucutt

SEQ ID NO: 3376 - DNA, 21 bp, Artificial Sequence
  Description of Artificial Sequence:  synthetic
  misc_feature (1)..(1): 5'-3 attached terminal deoxyabasic moeity
  misc_feature (2)..(3): 2'-deoxy-2'-fluoro
  misc_feature (5)..(5): 2'-deoxy-2'-fluoro
  misc_feature (7)..(8): 2'-deoxy-2'-fluoro
  misc_feature (12)..(13): 2'-deoxy-2'-fluoro
  misc_feature (15)..(16): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
accaugcuggacugcuggctt

SEQ ID NO: 3377 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(11): 2'-deoxy
  misc_feature (12)..(13): 2'-deoxy-2'-fluoro
  misc_feature (14)..(15): 2'-deoxy
  misc_feature (17)..(19): 2'-deoxy
  misc_feature (1)..(19): ribonucleotide modified as described
  misc_feature (21)..(21): 3'-3 attached terminal deoxyabasic moeity
accaugcuggacugcuggctt

SEQ ID NO: 3378 - DNA, 21 bp, Artificial Sequence
  Description of Artificial Sequence:  synthetic
  misc_feature (1)..(1): 2'-O-methyl
  misc_feature (4)..(5): 2'-O-methyl
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gccagcaguccagcauggutt

SEQ ID NO: 3379 - DNA, 21 bp, Artificial Sequence
  Description of Artificial Sequence:  synthetic
  misc_feature (6)..(6): 2'-deoxy-2'-fluoro
  misc_feature (9)..(11): 2'-deoxy-2'-fluoro
  misc_feature (14)..(14): 2'-deoxy-2'-fluoro
  misc_feature (16)..(16): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gccagcaguccagcauggutt

SEQ ID NO: 3380 - DNA, 21 bp, Artificial Sequence
  Description of Artificial Sequence:  synthetic
  misc_feature (1)..(1): 2'-O-methyl
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gccagcaguccagcauggutt

SEQ ID NO: 3381 - DNA, 21 bp, Artificial Sequence
  Description of Artificial Sequence:  synthetic
  misc_feature (1)..(1): 2'-O-methyl
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gccagcaguccagcauggutt

SEQ ID NO: 3382 - DNA, 21 bp, Artificial Sequence
  Description of Artificial Sequence:  synthetic
  misc_feature (1)..(1): 2'-O-methyl
  misc_feature (3)..(3): 2'-deoxy-2'-fluoro
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gccagcaguccagcauggutt

SEQ ID NO: 3383 - DNA, 21 bp, Artificial Sequence
  Description of Artificial Sequence:  synthetic
  misc_feature (2)..(3): 2'-O-methyl
  misc_feature (2)..(3): 2'-deoxy-2'-fluoro
  misc_feature (6)..(6): 2'-O-methyl
  misc_feature (6)..(6): 2'-deoxy-2'-fluoro
  misc_feature (9)..(11): 2'-O-methyl
  misc_feature (9)..(11): 2'-deoxy-2'-fluoro
  misc_feature (14)..(14): 2'-O-methyl
  misc_feature (14)..(14): 2'-deoxy-2'-fluoro
  misc_feature (16)..(16): 2'-O-methyl
  misc_feature (16)..(16): 2'-deoxy-2'-fluoro
  misc_feature (19)..(19): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gccagcaguccagcauggutt

SEQ ID NO: 3384 - DNA, 21 bp, Artificial Sequence
  Description of Artificial Sequence:  synthetic
  misc_feature (1)..(19): ribonucleotide modified as described
gcagaaaguccgucuggcatt

SEQ ID NO: 3385 - DNA, 21 bp, Artificial Sequence
  Description of Artificial Sequence:  synthetic
  misc_feature (1)..(19): ribonucleotide modified as described
cagaaaguccgucuggcagtt

SEQ ID NO: 3386 - DNA, 21 bp, Artificial Sequence
  Description of Artificial Sequence:  synthetic
  misc_feature (1)..(19): ribonucleotide modified as described
agaaaguccgucuggcagctt

SEQ ID NO: 3387 - DNA, 21 bp, Artificial Sequence
  Description of Artificial Sequence:  synthetic
  misc_feature (1)..(19): ribonucleotide modified as described
gcagccuggauauccucuctt

SEQ ID NO: 3388 - DNA, 21 bp, Artificial Sequence
  Description of Artificial Sequence:  synthetic
  misc_feature (1)..(19): ribonucleotide modified as described
cagccuggauauccucucctt

SEQ ID NO: 3389 - DNA, 21 bp, Artificial Sequence
  Description of Artificial Sequence:  synthetic
  misc_feature (1)..(19): ribonucleotide modified as described
cgggcucccuagcccugugtt

SEQ ID NO: 3390 - DNA, 21 bp, Artificial Sequence
  Description of Artificial Sequence:  synthetic
  misc_feature (1)..(19): ribonucleotide modified as described
gggcucccuagcccugugctt

SEQ ID NO: 3391 - DNA, 21 bp, Artificial Sequence
  Description of Artificial Sequence:  synthetic
  misc_feature (1)..(19): ribonucleotide modified as described
uccuucucuagacaggcgctt

SEQ ID NO: 3392 - DNA, 21 bp, Artificial Sequence
  Description of Artificial Sequence:  synthetic
  misc_feature (1)..(19): ribonucleotide modified as described
ccuucucuagacaggcgcutt

SEQ ID NO: 3393 - DNA, 21 bp, Artificial Sequence
  Description of Artificial Sequence:  synthetic
  misc_feature (1)..(19): ribonucleotide modified as described
cuucucuagacaggcgcugtt

SEQ ID NO: 3394 - DNA, 21 bp, Artificial Sequence
  Description of Artificial Sequence:  synthetic
  misc_feature (1)..(19): ribonucleotide modified as described
gguggaggugacugagugctt

SEQ ID NO: 3395 - DNA, 21 bp, Artificial Sequence
  Description of Artificial Sequence:  synthetic
  misc_feature (1)..(19): ribonucleotide modified as described
guggaggugacugagugcatt

SEQ ID NO: 3396 - DNA, 21 bp, Artificial Sequence
  Description of Artificial Sequence:  synthetic
  misc_feature (1)..(19): ribonucleotide modified as described
uggcauggucuucugugaatt

SEQ ID NO: 3397 - DNA, 21 bp, Artificial Sequence
  Description of Artificial Sequence:  synthetic
  misc_feature (1)..(19): ribonucleotide modified as described
ggcauggucuucugugaagtt

SEQ ID NO: 3398 - DNA, 21 bp, Artificial Sequence
  Description of Artificial Sequence:  synthetic
  misc_feature (1)..(19): ribonucleotide modified as described
aagcaaaaauuaaugaugatt

SEQ ID NO: 3399 - DNA, 21 bp, Artificial Sequence
  Description of Artificial Sequence:  synthetic
  misc_feature (1)..(19): ribonucleotide modified as described
agcaaaaauuaaugaugaatt

SEQ ID NO: 3400 - DNA, 21 bp, Artificial Sequence
  Description of Artificial Sequence:  synthetic
  misc_feature (1)..(19): ribonucleotide modified as described
aagaagaacagcacauuugtt

SEQ ID NO: 3401 - DNA, 21 bp, Artificial Sequence
  Description of Artificial Sequence:  synthetic
  misc_feature (1)..(19): ribonucleotide modified as described
cacauuugucaggguccautt

SEQ ID NO: 3402 - DNA, 21 bp, Artificial Sequence
  Description of Artificial Sequence:  synthetic
  misc_feature (1)..(19): ribonucleotide modified as described
uggcauggaaucucuggugtt

SEQ ID NO: 3403 - DNA, 21 bp, Artificial Sequence
  Description of Artificial Sequence:  synthetic
  misc_feature (1)..(19): ribonucleotide modified as described
ucucugguggaagccacggtt

SEQ ID NO: 3404 - DNA, 21 bp, Artificial Sequence
  Description of Artificial Sequence:  synthetic
  misc_feature (1)..(19): ribonucleotide modified as described
ucucucugguuguguaugutt

SEQ ID NO: 3405 - DNA, 21 bp, Artificial Sequence
  Description of Artificial Sequence:  synthetic
  misc_feature (1)..(19): ribonucleotide modified as described
cucucugguuguguauguctt

SEQ ID NO: 3406 - DNA, 21 bp, Artificial Sequence
  Description of Artificial Sequence:  synthetic
  misc_feature (1)..(19): ribonucleotide modified as described
aucucuccuguggauuccutt

SEQ ID NO: 3407 - DNA, 21 bp, Artificial Sequence
  Description of Artificial Sequence:  synthetic
  misc_feature (1)..(19): ribonucleotide modified as described
ucucuccuguggauuccuatt

SEQ ID NO: 3408 - DNA, 21 bp, Artificial Sequence
  Description of Artificial Sequence:  synthetic
  misc_feature (1)..(19): ribonucleotide modified as described
gucagcuuuguacaaaugutt

SEQ ID NO: 3409 - DNA, 21 bp, Artificial Sequence
  Description of Artificial Sequence:  synthetic
  misc_feature (1)..(19): ribonucleotide modified as described
caagacagcaacuugcaggtt

SEQ ID NO: 3410 - DNA, 21 bp, Artificial Sequence
  Description of Artificial Sequence:  synthetic
  misc_feature (1)..(19): ribonucleotide modified as described
aagacagcaacuugcaggatt

SEQ ID NO: 3411 - DNA, 21 bp, Artificial Sequence
  Description of Artificial Sequence:  synthetic
  misc_feature (1)..(19): ribonucleotide modified as described
agacagcaacuugcaggactt

SEQ ID NO: 3412 - DNA, 21 bp, Artificial Sequence
  Description of Artificial Sequence:  synthetic
  misc_feature (1)..(19): ribonucleotide modified as described
cauggugauuguggaauuctt

SEQ ID NO: 3413 - DNA, 21 bp, Artificial Sequence
  Description of Artificial Sequence:  synthetic
  misc_feature (1)..(19): ribonucleotide modified as described
auggugauuguggaauucutt

SEQ ID NO: 3414 - DNA, 21 bp, Artificial Sequence
  Description of Artificial Sequence:  synthetic
  misc_feature (1)..(19): ribonucleotide modified as described
ccucagugauguagaagaatt

SEQ ID NO: 3415 - DNA, 21 bp, Artificial Sequence
  Description of Artificial Sequence:  synthetic
  misc_feature (1)..(19): ribonucleotide modified as described
aagaagaggaagcuccugatt

SEQ ID NO: 3416 - DNA, 21 bp, Artificial Sequence
  Description of Artificial Sequence:  synthetic
  misc_feature (1)..(19): ribonucleotide modified as described
agaagaggaagcuccugaatt

SEQ ID NO: 3417 - DNA, 21 bp, Artificial Sequence
  Description of Artificial Sequence:  synthetic
  misc_feature (1)..(19): ribonucleotide modified as described
aggaagcuccugaagaucutt

SEQ ID NO: 3418 - DNA, 21 bp, Artificial Sequence
  Description of Artificial Sequence:  synthetic
  misc_feature (1)..(19): ribonucleotide modified as described
ggaagcuccugaagaucugtt

SEQ ID NO: 3419 - DNA, 21 bp, Artificial Sequence
  Description of Artificial Sequence:  synthetic
  misc_feature (1)..(19): ribonucleotide modified as described
ggcauggaguucuuggcautt

SEQ ID NO: 3420 - DNA, 21 bp, Artificial Sequence
  Description of Artificial Sequence:  synthetic
  misc_feature (1)..(19): ribonucleotide modified as described
gcugugggaaauauuuucctt

SEQ ID NO: 3421 - DNA, 21 bp, Artificial Sequence
  Description of Artificial Sequence:  synthetic
  misc_feature (1)..(19): ribonucleotide modified as described
cugugggaaauauuuuccutt

SEQ ID NO: 3422 - DNA, 21 bp, Artificial Sequence
  Description of Artificial Sequence:  synthetic
  misc_feature (1)..(19): ribonucleotide modified as described
uggaagaggauucuggacutt

SEQ ID NO: 3423 - DNA, 21 bp, Artificial Sequence
  Description of Artificial Sequence:  synthetic
  misc_feature (1)..(19): ribonucleotide modified as described
cucucucugccuaccucactt

SEQ ID NO: 3424 - DNA, 21 bp, Artificial Sequence
  Description of Artificial Sequence:  synthetic
  misc_feature (1)..(19): ribonucleotide modified as described
ucucucugccuaccucacctt

SEQ ID NO: 3425 - DNA, 21 bp, Artificial Sequence
  Description of Artificial Sequence:  synthetic
  misc_feature (1)..(19): ribonucleotide modified as described
gcugauagagauuggagugtt

SEQ ID NO: 3426 - DNA, 21 bp, Artificial Sequence
  Description of Artificial Sequence:  synthetic
  misc_feature (1)..(19): ribonucleotide modified as described
cugauagagauuggagugctt

SEQ ID NO: 3427 - DNA, 21 bp, Artificial Sequence
  Description of Artificial Sequence:  synthetic
  misc_feature (1)..(19): ribonucleotide modified as described
acagcccagauucuccagctt

SEQ ID NO: 3428 - DNA, 21 bp, Artificial Sequence
  Description of Artificial Sequence:  synthetic
  misc_feature (1)..(19): ribonucleotide modified as described
cagcccagauucuccagcctt

SEQ ID NO: 3429 - DNA, 21 bp, Artificial Sequence
  Description of Artificial Sequence:  synthetic
  misc_feature (1)..(19): ribonucleotide modified as described
agcccagauucuccagccutt

SEQ ID NO: 3430 - DNA, 21 bp, Artificial Sequence
  Description of Artificial Sequence:  synthetic
  misc_feature (1)..(19): ribonucleotide modified as described
gcccagauucuccagccugtt

SEQ ID NO: 3431 - DNA, 21 bp, Artificial Sequence
  Description of Artificial Sequence:  synthetic
  misc_feature (1)..(19): ribonucleotide modified as described
cucuccuccuguuuaaaagtt

SEQ ID NO: 3432 - DNA, 21 bp, Artificial Sequence
  Description of Artificial Sequence:  synthetic
  misc_feature (1)..(19): ribonucleotide modified as described
uccuggaagaggcuugugatt

SEQ ID NO: 3433 - DNA, 21 bp, Artificial Sequence
  Description of Artificial Sequence:  synthetic
  misc_feature (1)..(19): ribonucleotide modified as described
ccuggaagaggcuugugactt

SEQ ID NO: 3434 - DNA, 21 bp, Artificial Sequence
  Description of Artificial Sequence:  synthetic
  misc_feature (1)..(19): ribonucleotide modified as described
cuggaagaggcuugugacctt

SEQ ID NO: 3435 - DNA, 21 bp, Artificial Sequence
  Description of Artificial Sequence:  synthetic
  misc_feature (1)..(19): ribonucleotide modified as described
gaagaggcuugugacccaatt

SEQ ID NO: 3436 - DNA, 21 bp, Artificial Sequence
  Description of Artificial Sequence:  synthetic
  misc_feature (1)..(19): ribonucleotide modified as described
uugaagaugggaaggauuutt

SEQ ID NO: 3437 - DNA, 21 bp, Artificial Sequence
  Description of Artificial Sequence:  synthetic
  misc_feature (1)..(19): ribonucleotide modified as described
ugguggaggugggcaugggtt

SEQ ID NO: 3438 - DNA, 21 bp, Artificial Sequence
  Description of Artificial Sequence:  synthetic
  misc_feature (1)..(19): ribonucleotide modified as described
guugugcuguuucugacuctt

SEQ ID NO: 3439 - DNA, 21 bp, Artificial Sequence
  Description of Artificial Sequence:  synthetic
  misc_feature (1)..(19): ribonucleotide modified as described
uugugcuguuucugacucctt

SEQ ID NO: 3440 - DNA, 21 bp, Artificial Sequence
  Description of Artificial Sequence:  synthetic
  misc_feature (1)..(19): ribonucleotide modified as described
ugugcuguuucugacuccutt

SEQ ID NO: 3441 - DNA, 21 bp, Artificial Sequence
  Description of Artificial Sequence:  synthetic
  misc_feature (1)..(19): ribonucleotide modified as described
aaaguuucaggaaggauuutt

SEQ ID NO: 3442 - DNA, 21 bp, Artificial Sequence
  Description of Artificial Sequence:  synthetic
  misc_feature (1)..(19): ribonucleotide modified as described
aaguuucaggaaggauuuutt

SEQ ID NO: 3443 - DNA, 21 bp, Artificial Sequence
  Description of Artificial Sequence:  synthetic
  misc_feature (1)..(19): ribonucleotide modified as described
aguuucaggaaggauuuuatt

SEQ ID NO: 3444 - DNA, 21 bp, Artificial Sequence
  Description of Artificial Sequence:  synthetic
  misc_feature (1)..(19): ribonucleotide modified as described
aaaaaagaaaauguguuuutt

SEQ ID NO: 3445 - DNA, 21 bp, Artificial Sequence
  Description of Artificial Sequence:  synthetic
  misc_feature (1)..(19): ribonucleotide modified as described
auucacauuuuguaucagutt

SEQ ID NO: 3446 - DNA, 21 bp, Artificial Sequence
  Description of Artificial Sequence:  synthetic
  misc_feature (1)..(19): ribonucleotide modified as described
uucacauuuuguaucaguatt

SEQ ID NO: 3447 - DNA, 21 bp, Artificial Sequence
  Description of Artificial Sequence:  synthetic
  misc_feature (1)..(19): ribonucleotide modified as described
ucacauuuuguaucaguautt

SEQ ID NO: 3448 - DNA, 21 bp, Artificial Sequence
  Description of Artificial Sequence:  synthetic
  misc_feature (1)..(19): ribonucleotide modified as described
ugccagacggacuuucugctt

SEQ ID NO: 3449 - DNA, 21 bp, Artificial Sequence
  Description of Artificial Sequence:  synthetic
  misc_feature (1)..(19): ribonucleotide modified as described
cugccagacggacuuucugtt

SEQ ID NO: 3450 - DNA, 21 bp, Artificial Sequence
  Description of Artificial Sequence:  synthetic
  misc_feature (1)..(19): ribonucleotide modified as described
gcugccagacggacuuucutt

SEQ ID NO: 3451 - DNA, 21 bp, Artificial Sequence
  Description of Artificial Sequence:  synthetic
  misc_feature (1)..(19): ribonucleotide modified as described
gagaggauauccaggcugctt

SEQ ID NO: 3452 - DNA, 21 bp, Artificial Sequence
  Description of Artificial Sequence:  synthetic
  misc_feature (1)..(19): ribonucleotide modified as described
ggagaggauauccaggcugtt

SEQ ID NO: 3453 - DNA, 21 bp, Artificial Sequence
  Description of Artificial Sequence:  synthetic
  misc_feature (1)..(19): ribonucleotide modified as described
cacagggcuagggagcccgtt

SEQ ID NO: 3454 - DNA, 21 bp, Artificial Sequence
  Description of Artificial Sequence:  synthetic
  misc_feature (1)..(19): ribonucleotide modified as described
gcacagggcuagggagccctt

SEQ ID NO: 3455 - DNA, 21 bp, Artificial Sequence
  Description of Artificial Sequence:  synthetic
  misc_feature (1)..(19): ribonucleotide modified as described
gcgccugucuagagaaggatt

SEQ ID NO: 3456 - DNA, 21 bp, Artificial Sequence
  Description of Artificial Sequence:  synthetic
  misc_feature (1)..(19): ribonucleotide modified as described
agcgccugucuagagaaggtt

SEQ ID NO: 3457 - DNA, 21 bp, Artificial Sequence
  Description of Artificial Sequence:  synthetic
  misc_feature (1)..(19): ribonucleotide modified as described
cagcgccugucuagagaagtt

SEQ ID NO: 3458 - DNA, 21 bp, Artificial Sequence
  Description of Artificial Sequence:  synthetic
  misc_feature (1)..(19): ribonucleotide modified as described
gcacucagucaccuccacctt

SEQ ID NO: 3459 - DNA, 21 bp, Artificial Sequence
  Description of Artificial Sequence:  synthetic
  misc_feature (1)..(19): ribonucleotide modified as described
ugcacucagucaccuccactt

SEQ ID NO: 3460 - DNA, 21 bp, Artificial Sequence
  Description of Artificial Sequence:  synthetic
  misc_feature (1)..(19): ribonucleotide modified as described
uucacagaagaccaugccatt

SEQ ID NO: 3461 - DNA, 21 bp, Artificial Sequence
  Description of Artificial Sequence:  synthetic
  misc_feature (1)..(19): ribonucleotide modified as described
cuucacagaagaccaugcctt

SEQ ID NO: 3462 - DNA, 21 bp, Artificial Sequence
  Description of Artificial Sequence:  synthetic
  misc_feature (1)..(19): ribonucleotide modified as described
ucaucauuaauuuuugcuutt

SEQ ID NO: 3463 - DNA, 21 bp, Artificial Sequence
  Description of Artificial Sequence:  synthetic
  misc_feature (1)..(19): ribonucleotide modified as described
uucaucauuaauuuuugcutt

SEQ ID NO: 3464 - DNA, 21 bp, Artificial Sequence
  Description of Artificial Sequence:  synthetic
  misc_feature (1)..(19): ribonucleotide modified as described
caaaugugcuguucuucuutt

SEQ ID NO: 3465 - DNA, 21 bp, Artificial Sequence
  Description of Artificial Sequence:  synthetic
  misc_feature (1)..(19): ribonucleotide modified as described
auggacccugacaaaugugtt

SEQ ID NO: 3466 - DNA, 21 bp, Artificial Sequence
  Description of Artificial Sequence:  synthetic
  misc_feature (1)..(19): ribonucleotide modified as described
caccagagauuccaugccatt

SEQ ID NO: 3467 - DNA, 21 bp, Artificial Sequence
  Description of Artificial Sequence:  synthetic
  misc_feature (1)..(19): ribonucleotide modified as described
ccguggcuuccaccagagatt

SEQ ID NO: 3468 - DNA, 21 bp, Artificial Sequence
  Description of Artificial Sequence:  synthetic
  misc_feature (1)..(19): ribonucleotide modified as described
acauacacaaccagagagatt

SEQ ID NO: 3469 - DNA, 21 bp, Artificial Sequence
  Description of Artificial Sequence:  synthetic
  misc_feature (1)..(19): ribonucleotide modified as described
gacauacacaaccagagagtt

SEQ ID NO: 3470 - DNA, 21 bp, Artificial Sequence
  Description of Artificial Sequence:  synthetic
  misc_feature (1)..(19): ribonucleotide modified as described
aggaauccacaggagagautt

SEQ ID NO: 3471 - DNA, 21 bp, Artificial Sequence
  Description of Artificial Sequence:  synthetic
  misc_feature (1)..(19): ribonucleotide modified as described
uaggaauccacaggagagatt

SEQ ID NO: 3472 - DNA, 21 bp, Artificial Sequence
  Description of Artificial Sequence:  synthetic
  misc_feature (1)..(19): ribonucleotide modified as described
acauuuguacaaagcugactt

SEQ ID NO: 3473 - DNA, 21 bp, Artificial Sequence
  Description of Artificial Sequence:  synthetic
  misc_feature (1)..(19): ribonucleotide modified as described
ccugcaaguugcugucuugtt

SEQ ID NO: 3474 - DNA, 21 bp, Artificial Sequence
  Description of Artificial Sequence:  synthetic
  misc_feature (1)..(19): ribonucleotide modified as described
uccugcaaguugcugucuutt

SEQ ID NO: 3475 - DNA, 21 bp, Artificial Sequence
  Description of Artificial Sequence:  synthetic
  misc_feature (1)..(19): ribonucleotide modified as described
guccugcaaguugcugucutt

SEQ ID NO: 3476 - DNA, 21 bp, Artificial Sequence
  Description of Artificial Sequence:  synthetic
  misc_feature (1)..(19): ribonucleotide modified as described
gaauuccacaaucaccaugtt

SEQ ID NO: 3477 - DNA, 21 bp, Artificial Sequence
  Description of Artificial Sequence:  synthetic
  misc_feature (1)..(19): ribonucleotide modified as described
agaauuccacaaucaccautt

SEQ ID NO: 3478 - DNA, 21 bp, Artificial Sequence
  Description of Artificial Sequence:  synthetic
  misc_feature (1)..(19): ribonucleotide modified as described
uucuucuacaucacugaggtt

SEQ ID NO: 3479 - DNA, 21 bp, Artificial Sequence
  Description of Artificial Sequence:  synthetic
  misc_feature (1)..(19): ribonucleotide modified as described
ucaggagcuuccucuucuutt

SEQ ID NO: 3480 - DNA, 21 bp, Artificial Sequence
  Description of Artificial Sequence:  synthetic
  misc_feature (1)..(19): ribonucleotide modified as described
uucaggagcuuccucuucutt

SEQ ID NO: 3481 - DNA, 21 bp, Artificial Sequence
  Description of Artificial Sequence:  synthetic
  misc_feature (1)..(19): ribonucleotide modified as described
agaucuucaggagcuuccutt

SEQ ID NO: 3482 - DNA, 21 bp, Artificial Sequence
  Description of Artificial Sequence:  synthetic
  misc_feature (1)..(19): ribonucleotide modified as described
cagaucuucaggagcuucctt

SEQ ID NO: 3483 - DNA, 21 bp, Artificial Sequence
  Description of Artificial Sequence:  synthetic
  misc_feature (1)..(19): ribonucleotide modified as described
augccaagaacuccaugcctt

SEQ ID NO: 3484 - DNA, 21 bp, Artificial Sequence
  Description of Artificial Sequence:  synthetic
  misc_feature (1)..(19): ribonucleotide modified as described
ggaaaauauuucccacagctt

SEQ ID NO: 3485 - DNA, 21 bp, Artificial Sequence
  Description of Artificial Sequence:  synthetic
  misc_feature (1)..(19): ribonucleotide modified as described
aggaaaauauuucccacagtt

SEQ ID NO: 3486 - DNA, 21 bp, Artificial Sequence
  Description of Artificial Sequence:  synthetic
  misc_feature (1)..(19): ribonucleotide modified as described
aguccagaauccucuuccatt

SEQ ID NO: 3487 - DNA, 21 bp, Artificial Sequence
  Description of Artificial Sequence:  synthetic
  misc_feature (1)..(19): ribonucleotide modified as described
gugagguaggcagagagagtt

SEQ ID NO: 3488 - DNA, 21 bp, Artificial Sequence
  Description of Artificial Sequence:  synthetic
  misc_feature (1)..(19): ribonucleotide modified as described
ggugagguaggcagagagatt

SEQ ID NO: 3489 - DNA, 21 bp, Artificial Sequence
  Description of Artificial Sequence:  synthetic
  misc_feature (1)..(19): ribonucleotide modified as described
cacuccaaucucuaucagctt

SEQ ID NO: 3490 - DNA, 21 bp, Artificial Sequence
  Description of Artificial Sequence:  synthetic
  misc_feature (1)..(19): ribonucleotide modified as described
gcacuccaaucucuaucagtt

SEQ ID NO: 3491 - DNA, 21 bp, Artificial Sequence
  Description of Artificial Sequence:  synthetic
  misc_feature (1)..(19): ribonucleotide modified as described
gcuggagaaucugggcugutt

SEQ ID NO: 3492 - DNA, 21 bp, Artificial Sequence
  Description of Artificial Sequence:  synthetic
  misc_feature (1)..(19): ribonucleotide modified as described
ggcuggagaaucugggcugtt

SEQ ID NO: 3493 - DNA, 21 bp, Artificial Sequence
  Description of Artificial Sequence:  synthetic
  misc_feature (1)..(19): ribonucleotide modified as described
aggcuggagaaucugggcutt

SEQ ID NO: 3494 - DNA, 21 bp, Artificial Sequence
  Description of Artificial Sequence:  synthetic
  misc_feature (1)..(19): ribonucleotide modified as described
caggcuggagaaucugggctt

SEQ ID NO: 3495 - DNA, 21 bp, Artificial Sequence
  Description of Artificial Sequence:  synthetic
  misc_feature (1)..(19): ribonucleotide modified as described
cuuuuaaacaggaggagagtt

SEQ ID NO: 3496 - DNA, 21 bp, Artificial Sequence
  Description of Artificial Sequence:  synthetic
  misc_feature (1)..(19): ribonucleotide modified as described
ucacaagccucuuccaggatt

SEQ ID NO: 3497 - DNA, 21 bp, Artificial Sequence
  Description of Artificial Sequence:  synthetic
  misc_feature (1)..(19): ribonucleotide modified as described
gucacaagccucuuccaggtt

SEQ ID NO: 3498 - DNA, 21 bp, Artificial Sequence
  Description of Artificial Sequence:  synthetic
  misc_feature (1)..(19): ribonucleotide modified as described
ggucacaagccucuuccagtt

SEQ ID NO: 3499 - DNA, 21 bp, Artificial Sequence
  Description of Artificial Sequence:  synthetic
  misc_feature (1)..(19): ribonucleotide modified as described
uugggucacaagccucuuctt

SEQ ID NO: 3500 - DNA, 21 bp, Artificial Sequence
  Description of Artificial Sequence:  synthetic
  misc_feature (1)..(19): ribonucleotide modified as described
aaauccuucccaucuucaatt

SEQ ID NO: 3501 - DNA, 21 bp, Artificial Sequence
  Description of Artificial Sequence:  synthetic
  misc_feature (1)..(19): ribonucleotide modified as described
cccaugcccaccuccaccatt

SEQ ID NO: 3502 - DNA, 21 bp, Artificial Sequence
  Description of Artificial Sequence:  synthetic
  misc_feature (1)..(19): ribonucleotide modified as described
gagucagaaacagcacaactt

SEQ ID NO: 3503 - DNA, 21 bp, Artificial Sequence
  Description of Artificial Sequence:  synthetic
  misc_feature (1)..(19): ribonucleotide modified as described
ggagucagaaacagcacaatt

SEQ ID NO: 3504 - DNA, 21 bp, Artificial Sequence
  Description of Artificial Sequence:  synthetic
  misc_feature (1)..(19): ribonucleotide modified as described
aggagucagaaacagcacatt

SEQ ID NO: 3505 - DNA, 21 bp, Artificial Sequence
  Description of Artificial Sequence:  synthetic
  misc_feature (1)..(19): ribonucleotide modified as described
aaauccuuccugaaacuuutt

SEQ ID NO: 3506 - DNA, 21 bp, Artificial Sequence
  Description of Artificial Sequence:  synthetic
  misc_feature (1)..(19): ribonucleotide modified as described
aaaauccuuccugaaacuutt

SEQ ID NO: 3507 - DNA, 21 bp, Artificial Sequence
  Description of Artificial Sequence:  synthetic
  misc_feature (1)..(19): ribonucleotide modified as described
uaaaauccuuccugaaacutt

SEQ ID NO: 3508 - DNA, 21 bp, Artificial Sequence
  Description of Artificial Sequence:  synthetic
  misc_feature (1)..(19): ribonucleotide modified as described
aaaacacauuuucuuuuuutt

SEQ ID NO: 3509 - DNA, 21 bp, Artificial Sequence
  Description of Artificial Sequence:  synthetic
  misc_feature (1)..(19): ribonucleotide modified as described
acugauacaaaaugugaautt

SEQ ID NO: 3510 - DNA, 21 bp, Artificial Sequence
  Description of Artificial Sequence:  synthetic
  misc_feature (1)..(19): ribonucleotide modified as described
uacugauacaaaaugugaatt

SEQ ID NO: 3511 - DNA, 21 bp, Artificial Sequence
  Description of Artificial Sequence:  synthetic
  misc_feature (1)..(19): ribonucleotide modified as described
auacugauacaaaaugugatt

SEQ ID NO: 3512 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (4)..(8): 2'-deoxy-2'-fluoro
  misc_feature (10)..(10): 2'-deoxy-2'-fluoro
  misc_feature (14)..(16): 2'-deoxy-2'-fluoro
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
ccgccucuguggguuugcctt

SEQ ID NO: 3513 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (3)..(7): 2'-deoxy-2'-fluoro
  misc_feature (9)..(9): 2'-deoxy-2'-fluoro
  misc_feature (13)..(15): 2'-deoxy-2'-fluoro
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
cgccucuguggguuugccutt

SEQ ID NO: 3514 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(12): 2'-deoxy
  misc_feature (13)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
ccagaaaagagauuuguuctt

SEQ ID NO: 3515 - DNA, 21 bp, Artificial Sequence
  Description of Artificial Sequence:  synthetic
  misc_feature (1)..(2): 2'-deoxy
  misc_feature (1)..(1): 5'-3 attached terminal deoxyabasic moeity
  misc_feature (3)..(3): 2'-deoxy-2'-fluoro
  misc_feature (4)..(7): 2'-deoxy
  misc_feature (8)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aacagaauuuccugggacatt

SEQ ID NO: 3516 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (4)..(4): 2'-deoxy
  misc_feature (5)..(8): 2'-deoxy-2'-fluoro
  misc_feature (9)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
cuugucuuaaauuguacagtt

SEQ ID NO: 3517 - DNA, 21 bp, Artificial Sequence
  Description of Artificial Sequence:  synthetic
  misc_feature (1)..(9): 2'-deoxy
  misc_feature (1)..(1): 5'-3 attached terminal deoxyabasic moeity
  misc_feature (10)..(10): 2'-deoxy-2'-fluoro
  misc_feature (11)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aggaaaaaacaaaacuguatt

SEQ ID NO: 3518 - DNA, 21 bp, Artificial Sequence
  Description of Artificial Sequence:  synthetic
  misc_feature (1)..(1): 5'-3 attached terminal deoxyabasic moeity
  misc_feature (1)..(8): 2'-deoxy
  misc_feature (9)..(9): 2'-deoxy-2'-fluoro
  misc_feature (10)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ggaaaaaacaaaacuguaatt

SEQ ID NO: 3519 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(6): 2'-deoxy
  misc_feature (7)..(10): 2'-deoxy-2'-fluoro
  misc_feature (11)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cagggguccugaaauuacutt

SEQ ID NO: 3520 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(4): 2'-deoxy-2'-fluoro
  misc_feature (5)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gaccaagaaaagacauugctt

SEQ ID NO: 3521 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(6): 2'-deoxy-2'-fluoro
  misc_feature (7)..(7): 2'-deoxy
  misc_feature (8)..(8): 2'-deoxy-2'-fluoro
  misc_feature (9)..(9): 2'-deoxy
  misc_feature (10)..(12): 2'-deoxy-2'-fluoro
  misc_feature (13)..(13): 2'-deoxy
  misc_feature (14)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gccucuacaccugccaggctt

SEQ ID NO: 3522 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(15): 2'-deoxy-2'-fluoro
  misc_feature (16)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
uugccauguucuucuggcutt

SEQ ID NO: 3523 - DNA, 21 bp, Artificial Sequence
  Description of Artificial Sequence:  synthetic
  misc_feature (1)..(7): 2'-deoxy
  misc_feature (1)..(1): 5'-3 attached terminal deoxyabasic moeity
  misc_feature (8)..(9): 2'-deoxy-2'-fluoro
  misc_feature (10)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aggggaacugaagacaggctt

SEQ ID NO: 3524 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-O-methyl
  misc_feature (5)..(6): 2'-deoxy-2'-fluoro
  misc_feature (7)..(11): 2'-O-methyl
  misc_feature (12)..(12): 2'-deoxy-2'-fluoro
  misc_feature (13)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggaacugaagacaggcuactt

SEQ ID NO: 3525 - DNA, 21 bp, Artificial Sequence
  Description of Artificial Sequence:  synthetic
  misc_feature (1)..(3): 2'-O-methyl
  misc_feature (1)..(1): 5'-3 attached terminal deoxyabasic moeity
  misc_feature (4)..(5): 2'-deoxy-2'-fluoro
  misc_feature (6)..(10): 2'-O-methyl
  misc_feature (11)..(11): 2'-deoxy-2'-fluoro
  misc_feature (12)..(14): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
gaacugaagacaggcuacutt

SEQ ID NO: 3526 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(4): 2'-deoxy-2'-fluoro
  misc_feature (5)..(9): 2'-deoxy
  misc_feature (10)..(10): 2'-deoxy-2'-fluoro
  misc_feature (11)..(13): 2'-deoxy
  misc_feature (14)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
aacugaagacaggcuacuutt

SEQ ID NO: 3527 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(7): 2'-deoxy
  misc_feature (8)..(8): 2'-deoxy-2'-fluoro
  misc_feature (9)..(11): 2'-deoxy
  misc_feature (12)..(13): 2'-deoxy-2'-fluoro
  misc_feature (14)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cugaagacaggcuacuugutt

SEQ ID NO: 3528 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(6): 2'-deoxy-2'-fluoro
  misc_feature (7)..(7): 2'-deoxy
  misc_feature (8)..(8): 2'-deoxy-2'-fluoro
  misc_feature (9)..(10): 2'-deoxy
  misc_feature (11)..(11): 2'-deoxy-2'-fluoro
  misc_feature (12)..(12): 2'-deoxy
  misc_feature (13)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ugccuuaugaugccagcaatt

SEQ ID NO: 3529 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(5): 2'-deoxy-2'-fluoro
  misc_feature (6)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
cgcuuggacagcaucaccatt

SEQ ID NO: 3530 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy
  misc_feature (5)..(10): 2'-deoxy-2'-fluoro
  misc_feature (11)..(12): 2'-deoxy
  misc_feature (13)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
aggacuuccugaccuuggatt

SEQ ID NO: 3531 - DNA, 21 bp, Artificial Sequence
  Description of Artificial Sequence:  synthetic
  misc_feature (1)..(3): 2'-deoxy-2'-fluoro
  misc_feature (1)..(1): 5'-3 attached terminal deoxyabasic moeity
  misc_feature (4)..(7): 2'-deoxy
  misc_feature (8)..(8): 2'-deoxy-2'-fluoro
  misc_feature (9)..(9): 2'-deoxy
  misc_feature (10)..(13): 2'-deoxy-2'-fluoro
  misc_feature (14)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cuuggagcaucucaucugutt

SEQ ID NO: 3532 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(5): 2'-deoxy
  misc_feature (6)..(6): 2'-deoxy-2'-fluoro
  misc_feature (7)..(7): 2'-deoxy
  misc_feature (8)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
uggagcaucucaucuguuatt

SEQ ID NO: 3533 - DNA, 21 bp, Artificial Sequence
  Description of Artificial Sequence:  synthetic
  misc_feature (1)..(4): 2'-deoxy
  misc_feature (1)..(1): 5'-3 attached terminal deoxyabasic moeity
  misc_feature (5)..(5): 2'-deoxy-2'-fluoro
  misc_feature (6)..(6): 2'-deoxy
  misc_feature (7)..(10): 2'-deoxy-2'-fluoro
  misc_feature (11)..(11): 2'-deoxy
  misc_feature (12)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggagcaucucaucuguuactt

SEQ ID NO: 3534 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (2)..(2): 2'-deoxy-2'-fluoro
  misc_feature (3)..(3): 2'-deoxy
  misc_feature (4)..(7): 2'-deoxy-2'-fluoro
  misc_feature (8)..(8): 2'-deoxy
  misc_feature (9)..(11): 2'-deoxy-2'-fluoro
  misc_feature (12)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gcaucucaucuguuacagctt

SEQ ID NO: 3535 - DNA, 21 bp, Artificial Sequence
  Description of Artificial Sequence:  synthetic
  misc_feature (1)..(3): 2'-deoxy-2'-fluoro
  misc_feature (1)..(1): 5'-3 attached terminal deoxyabasic moeity
  misc_feature (4)..(4): 2'-deoxy
  misc_feature (5)..(6): 2'-deoxy-2'-fluoro
  misc_feature (7)..(7): 2'-deoxy
  misc_feature (8)..(8): 2'-deoxy-2'-fluoro
  misc_feature (9)..(10): 2'-deoxy
  misc_feature (11)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ucuguuacagcuuccaagutt

SEQ ID NO: 3536 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(11): 2'-deoxy-2'-fluoro
  misc_feature (12)..(14): 2'-deoxy
  misc_feature (15)..(15): 2'-deoxy-2'-fluoro
  misc_feature (16)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
uuacagcuuccaaguggcutt

SEQ ID NO: 3537 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(4): 2'-deoxy
  misc_feature (5)..(5): 2'-deoxy-2'-fluoro
  misc_feature (6)..(7): 2'-deoxy
  misc_feature (8)..(9): 2'-deoxy-2'-fluoro
  misc_feature (10)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
caaguggcuaagggcauggtt

SEQ ID NO: 3538 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(14): 2'-deoxy-2'-fluoro
  misc_feature (15)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggcauggaguucuuggcautt

SEQ ID NO: 3539 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(8): 2'-deoxy
  misc_feature (9)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
gcauggaguucuuggcauctt

SEQ ID NO: 3540 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(13): 2'-deoxy
  misc_feature (14)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
gcauggaagaggauucuggtt

SEQ ID NO: 3541 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(3): 2'-deoxy-2'-fluoro
  misc_feature (4)..(12): 2'-deoxy
  misc_feature (13)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
cauggaagaggauucuggatt

SEQ ID NO: 3542 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(10): 2'-deoxy
  misc_feature (11)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
uggaagaggauucuggacutt

SEQ ID NO: 3543 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(3): 2'-deoxy
  misc_feature (4)..(6): 2'-deoxy-2'-fluoro
  misc_feature (7)..(7): 2'-deoxy
  misc_feature (8)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
cugccuaccucaccuguuutt

SEQ ID NO: 3544 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(10): 2'-deoxy-2'-fluoro
  misc_feature (11)..(11): 2'-deoxy
  misc_feature (12)..(14): 2'-deoxy-2'-fluoro
  misc_feature (15)..(15): 2'-deoxy
  misc_feature (16)..(19): 2'-deoxy-2'-fluoro
  misc_feature (1)..(19): ribonucleotide modified as described
  misc_feature (21)..(21): 3'-3 attached terminal deoxyabasic moeity
ugccuaccucaccuguuuctt

SEQ ID NO: 3545 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(4): 2'-deoxy-2'-fluoro
  misc_feature (5)..(5): 2'-deoxy
  misc_feature (6)..(9): 2'-deoxy-2'-fluoro
  misc_feature (10)..(10): 2'-deoxy
  misc_feature (11)..(13): 2'-deoxy-2'-fluoro
  misc_feature (14)..(14): 2'-deoxy
  misc_feature (15)..(19): 2'-deoxy-2'-fluoro
  misc_feature (1)..(19): ribonucleotide modified as described
  misc_feature (21)..(21): 3'-3 attached terminal deoxyabasic moeity
gccuaccucaccuguuucctt

SEQ ID NO: 3546 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(3): 2'-deoxy
  misc_feature (4)..(6): 2'-deoxy-2'-fluoro
  misc_feature (7)..(7): 2'-deoxy
  misc_feature (8)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ucaccuguuuccuguauggtt

SEQ ID NO: 3547 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
auuccauuaugacaacacatt

SEQ ID NO: 3548 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-deoxy
  misc_feature (6)..(6): 2'-deoxy-2'-fluoro
  misc_feature (7)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
cauuaugacaacacagcagtt

SEQ ID NO: 3549 - DNA, 21 bp, Artificial Sequence
  Description of Artificial Sequence:  synthetic
  misc_feature (7)..(9): 2'-deoxy-2'-fluoro
  misc_feature (11)..(11): 2'-deoxy-2'-fluoro
  misc_feature (17)..(17): 2'-deoxy-2'-fluoro
  misc_feature (1)..(19): ribonucleotide modified as described
ggcaaacccacagaggcggtt

SEQ ID NO: 3550 - DNA, 21 bp, Artificial Sequence
  Description of Artificial Sequence:  synthetic
  misc_feature (4)..(4): 2'-deoxy-2'-fluoro
  misc_feature (8)..(10): 2'-deoxy-2'-fluoro
  misc_feature (12)..(12): 2'-deoxy-2'-fluoro
  misc_feature (18)..(18): 2'-deoxy-2'-fluoro
  misc_feature (1)..(19): ribonucleotide modified as described
aggcaaacccacagaggcgtt

SEQ ID NO: 3551 - DNA, 21 bp, Artificial Sequence
  Description of Artificial Sequence:  synthetic
  misc_feature (4)..(4): 2'-deoxy-2'-fluoro
  misc_feature (8)..(17): 2'-deoxy-2'-fluoro
  misc_feature (1)..(19): ribonucleotide modified as described
gaacaaaucucuuuucuggtt

SEQ ID NO: 3552 - DNA, 21 bp, Artificial Sequence
  Description of Artificial Sequence:  synthetic
  misc_feature (4)..(6): 2'-deoxy-2'-fluoro
  misc_feature (13)..(16): 2'-deoxy-2'-fluoro
  misc_feature (18)..(19): 2'-deoxy-2'-fluoro
  misc_feature (1)..(19): ribonucleotide modified as described
ugucccaggaaauucuguutt

SEQ ID NO: 3553 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(15): 2'-O-methyl
  misc_feature (16)..(16): 2'-deoxy-2'-fluoro
  misc_feature (17)..(19): 2'-O-methyl
  misc_feature (1)..(19): ribonucleotide modified as described
cuguacaauuuaagacaagtt

SEQ ID NO: 3554 - DNA, 21 bp, Artificial Sequence
  Description of Artificial Sequence:  synthetic
  misc_feature (4)..(5): 2'-O-methyl
  misc_feature (6)..(9): 2'-deoxy-2'-fluoro
  misc_feature (10)..(10): 2'-O-methyl
  misc_feature (11)..(19): 2'-deoxy-2'-fluoro
  misc_feature (1)..(19): ribonucleotide modified as described
uacaguuuuguuuuuuccutt

SEQ ID NO: 3555 - DNA, 21 bp, Artificial Sequence
  Description of Artificial Sequence:  synthetic
  misc_feature (4)..(4): 2'-deoxy-2'-fluoro
  misc_feature (5)..(6): 2'-O-methyl
  misc_feature (7)..(10): 2'-deoxy-2'-fluoro
  misc_feature (11)..(11): 2'-O-methyl
  misc_feature (12)..(19): 2'-deoxy-2'-fluoro
  misc_feature (1)..(19): ribonucleotide modified as described
uuacaguuuuguuuuuucctt

SEQ ID NO: 3556 - DNA, 21 bp, Artificial Sequence
  Description of Artificial Sequence:  synthetic
  misc_feature (4)..(5): 2'-O-methyl
  misc_feature (6)..(9): 2'-deoxy-2'-fluoro
  misc_feature (10)..(13): 2'-O-methyl
  misc_feature (14)..(18): 2'-deoxy-2'-fluoro
  misc_feature (19)..(19): 2'-O-methyl
  misc_feature (1)..(19): ribonucleotide modified as described
aguaauuucaggaccccugtt

SEQ ID NO: 3557 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(15): 2'-deoxy-2'-fluoro
  misc_feature (16)..(17): 2'-O-methyl
  misc_feature (18)..(19): 2'-deoxy-2'-fluoro
  misc_feature (1)..(19): ribonucleotide modified as described
gcaaugucuuuucuugguctt

SEQ ID NO: 3558 - DNA, 21 bp, Artificial Sequence
  Description of Artificial Sequence:  synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(10): 2'-O-methyl
  misc_feature (11)..(11): 2'-deoxy-2'-fluoro
  misc_feature (12)..(12): 2'-O-methyl
  misc_feature (13)..(13): 2'-deoxy-2'-fluoro
  misc_feature (14)..(18): 2'-O-methyl
  misc_feature (19)..(19): 2'-deoxy-2'-fluoro
  misc_feature (1)..(19): ribonucleotide modified as described
gccuggcagguguagaggctt

SEQ ID NO: 3559 - DNA, 21 bp, Artificial Sequence
  Description of Artificial Sequence:  synthetic
  misc_feature (4)..(4): 2'-deoxy-2'-fluoro
  misc_feature (5)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
agccagaagaacauggcaatt

SEQ ID NO: 3560 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(12): 2'-O-methyl
  misc_feature (13)..(19): 2'-deoxy-2'-fluoro
  misc_feature (1)..(19): ribonucleotide modified as described
gccugucuucaguuccccutt

SEQ ID NO: 3561 - DNA, 21 bp, Artificial Sequence
  Description of Artificial Sequence:  synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(13): 2'-deoxy-2'-fluoro
  misc_feature (14)..(15): 2'-O-methyl
  misc_feature (16)..(19): 2'-deoxy-2'-fluoro
  misc_feature (1)..(19): ribonucleotide modified as described
guagccugucuucaguucctt

SEQ ID NO: 3562 - DNA, 21 bp, Artificial Sequence
  Description of Artificial Sequence:  synthetic
  misc_feature (4)..(5): 2'-O-methyl
  misc_feature (6)..(8): 2'-deoxy-2'-fluoro
  misc_feature (9)..(9): 2'-O-methyl
  misc_feature (10)..(14): 2'-deoxy-2'-fluoro
  misc_feature (15)..(16): 2'-O-methyl
  misc_feature (17)..(19): 2'-deoxy-2'-fluoro
  misc_feature (1)..(19): ribonucleotide modified as described
aguagccugucuucaguuctt

SEQ ID NO: 3563 - DNA, 21 bp, Artificial Sequence
  Description of Artificial Sequence:  synthetic
  misc_feature (4)..(4): 2'-deoxy-2'-fluoro
  misc_feature (5)..(6): 2'-O-methyl
  misc_feature (7)..(9): 2'-deoxy-2'-fluoro
  misc_feature (10)..(10): 2'-O-methyl
  misc_feature (11)..(15): 2'-deoxy-2'-fluoro
  misc_feature (16)..(17): 2'-O-methyl
  misc_feature (18)..(19): 2'-deoxy-2'-fluoro
  misc_feature (1)..(19): ribonucleotide modified as described
aaguagccugucuucaguutt

SEQ ID NO: 3564 - DNA, 21 bp, Artificial Sequence
  Description of Artificial Sequence:  synthetic
  misc_feature (4)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(12): 2'-O-methyl
  misc_feature (13)..(17): 2'-deoxy-2'-fluoro
  misc_feature (18)..(19): 2'-O-methyl
  misc_feature (1)..(19): ribonucleotide modified as described
acaaguagccugucuucagtt

SEQ ID NO: 3565 - DNA, 21 bp, Artificial Sequence
  Description of Artificial Sequence:  synthetic
  misc_feature (4)..(5): 2'-deoxy-2'-fluoro
  misc_feature (6)..(7): 2'-O-methyl
  misc_feature (8)..(8): 2'-deoxy-2'-fluoro
  misc_feature (9)..(9): 2'-O-methyl
  misc_feature (10)..(11): 2'-deoxy-2'-fluoro
  misc_feature (12)..(12): 2'-O-methyl
  misc_feature (13)..(13): 2'-deoxy-2'-fluoro
  misc_feature (14)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uugcuggcaucauaaggcatt

SEQ ID NO: 3566 - DNA, 21 bp, Artificial Sequence
  Description of Artificial Sequence:  synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uggugaugcuguccaagcgtt

SEQ ID NO: 3567 - DNA, 21 bp, Artificial Sequence
  Description of Artificial Sequence:  synthetic
  misc_feature (4)..(7): 2'-O-methyl
  misc_feature (8)..(9): 2'-deoxy-2'-fluoro
  misc_feature (10)..(15): 2'-O-methyl
  misc_feature (16)..(19): 2'-deoxy-2'-fluoro
  misc_feature (1)..(19): ribonucleotide modified as described
uccaaggucaggaaguccutt

SEQ ID NO: 3568 - DNA, 21 bp, Artificial Sequence
  Description of Artificial Sequence:  synthetic
  misc_feature (4)..(5): 2'-O-methyl
  misc_feature (6)..(6): 2'-deoxy-2'-fluoro
  misc_feature (7)..(10): 2'-O-methyl
  misc_feature (11)..(11): 2'-deoxy-2'-fluoro
  misc_feature (12)..(12): 2'-O-methyl
  misc_feature (13)..(16): 2'-deoxy-2'-fluoro
  misc_feature (17)..(19): 2'-O-methyl
  misc_feature (1)..(19): ribonucleotide modified as described
acagaugagaugcuccaagtt

SEQ ID NO: 3569 - DNA, 21 bp, Artificial Sequence
  Description of Artificial Sequence:  synthetic
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(12): 2'-O-methyl
  misc_feature (13)..(13): 2'-deoxy-2'-fluoro
  misc_feature (14)..(14): 2'-O-methyl
  misc_feature (15)..(18): 2'-deoxy-2'-fluoro
  misc_feature (19)..(19): 2'-O-methyl
  misc_feature (1)..(19): ribonucleotide modified as described
uaacagaugagaugcuccatt

SEQ ID NO: 3570 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(9): 2'-deoxy-2'-fluoro
  misc_feature (10)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (1)..(19): ribonucleotide modified as described
guaacagaugagaugcucctt

SEQ ID NO: 3571 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
gcuguaacagaugagaugctt

SEQ ID NO: 3572 - DNA, 21 bp, Artificial Sequence
  Description of Artificial Sequence:  synthetic
  misc_feature (4)..(4): 2'-deoxy-2'-fluoro
  misc_feature (5)..(9): 2'-O-methyl
  misc_feature (10)..(11): 2'-deoxy-2'-fluoro
  misc_feature (12)..(12): 2'-O-methyl
  misc_feature (13)..(13): 2'-deoxy-2'-fluoro
  misc_feature (14)..(15): 2'-O-methyl
  misc_feature (16)..(16): 2'-deoxy-2'-fluoro
  misc_feature (17)..(19): 2'-O-methyl
  misc_feature (1)..(19): ribonucleotide modified as described
acuuggaagcuguaacagatt

SEQ ID NO: 3573 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (9)..(13): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
agccacuuggaagcuguaatt

SEQ ID NO: 3574 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
ccaugcccuuagccacuugtt

SEQ ID NO: 3575 - DNA, 21 bp, Artificial Sequence
  Description of Artificial Sequence:  synthetic
  misc_feature (4)..(5): 2'-deoxy-2'-fluoro
  misc_feature (6)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
augccaagaacuccaugcctt

SEQ ID NO: 3576 - DNA, 21 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(11): 2'-O-methyl
  misc_feature (12)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
gaugccaagaacuccaugctt

SEQ ID NO: 3577 - DNA, 21 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(12): 2'-deoxy-2'-fluoro
  misc_feature (13)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uccaccaacucugaaaacgtt

SEQ ID NO: 3578 - DNA, 21 bp, Artificial Sequence
  Description of Artificial Sequence:  synthetic
  misc_feature (4)..(6): 2'-O-methyl
  misc_feature (7)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
ccagaauccucuuccaugctt

SEQ ID NO: 3579 - DNA, 21 bp, Artificial Sequence
  Description of Artificial Sequence:  synthetic
  misc_feature (4)..(7): 2'-O-methyl
  misc_feature (8)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uccagaauccucuuccaugtt

SEQ ID NO: 3580 - DNA, 21 bp, Artificial Sequence
  Description of Artificial Sequence:  synthetic
  misc_feature (4)..(5): 2'-deoxy-2'-fluoro
  misc_feature (6)..(9): 2'-O-methyl
  misc_feature (10)..(18): 2'-deoxy-2'-fluoro
  misc_feature (19)..(19): 2'-O-methyl
  misc_feature (1)..(19): ribonucleotide modified as described
aguccagaauccucuuccatt

SEQ ID NO: 3581 - DNA, 21 bp, Artificial Sequence
  Description of Artificial Sequence:  synthetic
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(12): 2'-O-methyl
  misc_feature (13)..(13): 2'-deoxy-2'-fluoro
  misc_feature (14)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
aaacaggugagguaggcagtt

SEQ ID NO: 3582 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(9): 2'-deoxy-2'-fluoro
  misc_feature (10)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
gaaacaggugagguaggcatt

SEQ ID NO: 3583 - DNA, 21 bp, Artificial Sequence
  Description of Artificial Sequence:  synthetic
  misc_feature (4)..(5): 2'-O-methyl
  misc_feature (6)..(6): 2'-deoxy-2'-fluoro
  misc_feature (7)..(9): 2'-O-methyl
  misc_feature (10)..(10): 2'-deoxy-2'-fluoro
  misc_feature (11)..(14): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
ggaaacaggugagguaggctt

SEQ ID NO: 3584 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(12): 2'-O-methyl
  misc_feature (13)..(13): 2'-deoxy-2'-fluoro
  misc_feature (14)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
ccauacaggaaacaggugatt

SEQ ID NO: 3585 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uccauacaggaaacaggugtt

SEQ ID NO: 3586 - DNA, 21 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (1)..(19): ribonucleotide modified as described
uguguugucauaauggaautt

SEQ ID NO: 3587 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(13): 2'-deoxy-2'-fluoro
  misc_feature (14)..(14): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
cugcuguguugucauaaugtt

SEQ ID NO: 3588 - DNA, 21 bp, Artificial Sequence
  Description of Artificial Sequence:  synthetic
  misc_feature (4)..(5): 2'-O-methyl
  misc_feature (6)..(10): 2'-deoxy-2'-fluoro
  misc_feature (11)..(11): 2'-O-methyl
  misc_feature (12)..(13): 2'-deoxy-2'-fluoro
  misc_feature (14)..(14): 2'-O-methyl
  misc_feature (15)..(15): 2'-deoxy-2'-fluoro
  misc_feature (16)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
acugauuccugcuguguugtt

SEQ ID NO: 3589 - DNA, 21 bp, Artificial Sequence
  Description of Artificial Sequence:  synthetic
  misc_feature (1)..(19): ribonucleotide modified as described
cacugccacaagaaguacctt

SEQ ID NO: 3590 - DNA, 21 bp, Artificial Sequence
  Description of Artificial Sequence:  synthetic
  misc_feature (1)..(19): ribonucleotide modified as described
gaagcagagagagagaaggtt

SEQ ID NO: 3591 - DNA, 21 bp, Artificial Sequence
  Description of Artificial Sequence:  synthetic
  misc_feature (1)..(19): ribonucleotide modified as described
agaggaaccaggaggacaatt

SEQ ID NO: 3592 - DNA, 21 bp, Artificial Sequence
  Description of Artificial Sequence:  synthetic
  misc_feature (1)..(19): ribonucleotide modified as described
caagaggagcaugaaagugtt

SEQ ID NO: 3593 - DNA, 21 bp, Artificial Sequence
  Description of Artificial Sequence:  synthetic
  misc_feature (1)..(19): ribonucleotide modified as described
gguacuucuuguggcagugtt

SEQ ID NO: 3594 - DNA, 21 bp, Artificial Sequence
  Description of Artificial Sequence:  synthetic
  misc_feature (1)..(19): ribonucleotide modified as described
ccuucucucucucugcuuctt

SEQ ID NO: 3595 - DNA, 21 bp, Artificial Sequence
  Description of Artificial Sequence:  synthetic
  misc_feature (1)..(19): ribonucleotide modified as described
uuguccuccugguuccucutt

SEQ ID NO: 3596 - DNA, 21 bp, Artificial Sequence
  Description of Artificial Sequence:  synthetic
  misc_feature (1)..(19): ribonucleotide modified as described
cacuuucaugcuccucuugtt

SEQ ID NO: 3597 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (3)..(4): 2'-deoxy-2'-fluoro
  misc_feature (6)..(7): 2'-deoxy-2'-fluoro
  misc_feature (9)..(9): 2'-deoxy-2'-fluoro
  misc_feature (16)..(16): 2'-deoxy-2'-fluoro
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cacugccacaagaaguacctt

SEQ ID NO: 3598 - DNA, 21 bp, Artificial Sequence
  Description of Artificial Sequence:  synthetic
  misc_feature (1)..(1): 5'-3 attached terminal deoxyabasic moeity
  misc_feature (5)..(5): 2'-deoxy-2'-fluoro
  misc_feature (1)..(19): ribonucleotide modified as described
  misc_feature (21)..(21): 3'-3 attached terminal deoxyabasic moeity
gaagcagagagagagaaggtt

SEQ ID NO: 3599 - DNA, 21 bp, Artificial Sequence
  Description of Artificial Sequence:  synthetic
  misc_feature (1)..(1): 5'-3 attached terminal deoxyabasic moeity
  misc_feature (8)..(9): 2'-deoxy-2'-fluoro
  misc_feature (17)..(17): 2'-deoxy-2'-fluoro
  misc_feature (1)..(19): ribonucleotide modified as described
  misc_feature (21)..(21): 3'-3 attached terminal deoxyabasic moeity
agaggaaccaggaggacaatt

SEQ ID NO: 3600 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (10)..(10): 2'-deoxy-2'-fluoro
  misc_feature (12)..(12): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
caagaggagcaugaaagugtt

SEQ ID NO: 3601 - DNA, 21 bp, Artificial Sequence
  Description of Artificial Sequence:  synthetic
  misc_feature (3)..(3): 2'-deoxy-2'-fluoro
  misc_feature (5)..(10): 2'-deoxy-2'-fluoro
  misc_feature (12)..(12): 2'-deoxy-2'-fluoro
  misc_feature (15)..(15): 2'-deoxy-2'-fluoro
  misc_feature (18)..(18): 2'-deoxy-2'-fluoro
  misc_feature (1)..(19): ribonucleotide modified as described
  misc_feature (20)..(20): Phosphorothioate 3'-Internucleotide Linkage
gguacuucuuguggcagugtt

SEQ ID NO: 3602 - DNA, 21 bp, Artificial Sequence
  Description of Artificial Sequence:  synthetic
  misc_feature (1)..(14): 2'-deoxy-2'-fluoro
  misc_feature (16)..(19): 2'-deoxy-2'-fluoro
  misc_feature (1)..(19): ribonucleotide modified as described
  misc_feature (20)..(20): Phosphorothioate 3'-Internucleotide Linkage
ccuucucucucucugcuuctt

SEQ ID NO: 3603 - DNA, 21 bp, Artificial Sequence
  Description of Artificial Sequence:  synthetic
  misc_feature (1)..(2): 2'-deoxy-2'-fluoro
  misc_feature (4)..(10): 2'-deoxy-2'-fluoro
  misc_feature (13)..(19): 2'-deoxy-2'-fluoro
  misc_feature (1)..(19): ribonucleotide modified as described
  misc_feature (20)..(20): Phosphorothioate 3'-Internucleotide Linkage
uuguccuccugguuccucutt

SEQ ID NO: 3604 - DNA, 21 bp, Artificial Sequence
  Description of Artificial Sequence:  synthetic
  misc_feature (1)..(1): 2'-deoxy-2'-fluoro
  misc_feature (3)..(7): 2'-deoxy-2'-fluoro
  misc_feature (9)..(9): 2'-deoxy-2'-fluoro
  misc_feature (11)..(18): 2'-deoxy-2'-fluoro
  misc_feature (1)..(19): ribonucleotide modified as described
  misc_feature (20)..(20): Phosphorothioate 3'-Internucleotide Linkage
cacuuucaugcuccucuugtt

SEQ ID NO: 3605 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(9): 2'-deoxy-2'-fluoro
  misc_feature (10)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
cacugccacaagaaguacctt

SEQ ID NO: 3606 - DNA, 21 bp, Artificial Sequence
  Description of Artificial Sequence:  synthetic
  misc_feature (1)..(4): 2'-deoxy
  misc_feature (1)..(1): 5'-3 attached terminal deoxyabasic moeity
  misc_feature (5)..(5): 2'-deoxy-2'-fluoro
  misc_feature (6)..(19): 2'-deoxy
  misc_feature (1)..(19): ribonucleotide modified as described
  misc_feature (21)..(21): 3'-3 attached terminal deoxyabasic moeity
gaagcagagagagagaaggtt

SEQ ID NO: 3607 - DNA, 21 bp, Artificial Sequence
  Description of Artificial Sequence:  synthetic
  misc_feature (1)..(7): 2'-deoxy
  misc_feature (1)..(1): 5'-3 attached terminal deoxyabasic moeity
  misc_feature (8)..(9): 2'-deoxy-2'-fluoro
  misc_feature (10)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
agaggaaccaggaggacaatt

SEQ ID NO: 3608 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
caagaggagcaugaaagugtt

SEQ ID NO: 3609 - DNA, 21 bp, Artificial Sequence
  Description of Artificial Sequence:  synthetic
  misc_feature (1)..(2): 2'-deoxy
  misc_feature (3)..(3): 2'-deoxy-2'-fluoro
  misc_feature (4)..(4): 2'-deoxy
  misc_feature (5)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (20)..(20): Phosphorothioate 3'-Internucleotide Linkage
gguacuucuuguggcagugtt

SEQ ID NO: 3610 - DNA, 21 bp, Artificial Sequence
  Description of Artificial Sequence:  synthetic
  misc_feature (1)..(14): 2'-deoxy-2'-fluoro
  misc_feature (15)..(15): 2'-deoxy
  misc_feature (16)..(19): 2'-deoxy-2'-fluoro
  misc_feature (1)..(19): ribonucleotide modified as described
  misc_feature (20)..(20): Phosphorothioate 3'-Internucleotide Linkage
ccuucucucucucugcuuctt

SEQ ID NO: 3611 - DNA, 21 bp, Artificial Sequence
  Description of Artificial Sequence:  synthetic
  misc_feature (1)..(2): 2'-deoxy-2'-fluoro
  misc_feature (3)..(3): 2'-deoxy
  misc_feature (4)..(10): 2'-deoxy-2'-fluoro
  misc_feature (11)..(12): 2'-deoxy
  misc_feature (13)..(19): 2'-deoxy-2'-fluoro
  misc_feature (1)..(19): ribonucleotide modified as described
  misc_feature (20)..(20): Phosphorothioate 3'-Internucleotide Linkage
uuguccuccugguuccucutt

SEQ ID NO: 3612 - DNA, 21 bp, Artificial Sequence
  Description of Artificial Sequence:  synthetic
  misc_feature (1)..(1): 2'-deoxy-2'-fluoro
  misc_feature (2)..(2): 2'-deoxy
  misc_feature (3)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(18): 2'-deoxy-2'-fluoro
  misc_feature (19)..(19): 2'-deoxy
  misc_feature (1)..(19): ribonucleotide modified as described
  misc_feature (20)..(20): Phosphorothioate 3'-Internucleotide Linkage
cacuuucaugcuccucuugtt

SEQ ID NO: 3613 - DNA, 21 bp, Artificial Sequence
  Description of Artificial Sequence:  synthetic
  misc_feature (1)..(19): ribonucleotide modified as described
uucuaugugaccaccaucctt

SEQ ID NO: 3614 - DNA, 21 bp, Artificial Sequence
  Description of Artificial Sequence:  synthetic
  misc_feature (1)..(19): ribonucleotide modified as described
agcacugccacaagaaguatt

SEQ ID NO: 3615 - DNA, 21 bp, Artificial Sequence
  Description of Artificial Sequence:  synthetic
  misc_feature (1)..(19): ribonucleotide modified as described
uacggcaaccucuccaacutt

SEQ ID NO: 3616 - DNA, 21 bp, Artificial Sequence
  Description of Artificial Sequence:  synthetic
  misc_feature (1)..(19): ribonucleotide modified as described
ggaugguggucacauagaatt

SEQ ID NO: 3617 - DNA, 21 bp, Artificial Sequence
  Description of Artificial Sequence:  synthetic
  misc_feature (1)..(19): ribonucleotide modified as described
uacuucuuguggcagugcutt

SEQ ID NO: 3618 - DNA, 21 bp, Artificial Sequence
  Description of Artificial Sequence:  synthetic
  misc_feature (1)..(19): ribonucleotide modified as described
aguuggagagguugccguatt

SEQ ID NO: 3619 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gccauguacaaguguguggtt

SEQ ID NO: 3620 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
uucuaugugaccaccaucctt

SEQ ID NO: 3621 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
agcacugccacaagaaguatt

SEQ ID NO: 3622 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
cacugccacaagaaguacctt

SEQ ID NO: 3623 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
ugccacaagaaguaccugutt

SEQ ID NO: 3624 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
uacggcaaccucuccaacutt

SEQ ID NO: 3625 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
gugaagaucugugacuuugtt

SEQ ID NO: 3626 - DNA, 21 bp, Artificial Sequence
  Description of Artificial Sequence:  synthetic
  misc_feature (1)..(1): 5'-3 attached terminal deoxyabasic moeity
  misc_feature (21)..(21): 3'-3 attached terminal deoxyabasic moeity
  misc_feature (1)..(19): ribonucleotide modified as described
agaucugugacuuuggccutt

SEQ ID NO: 3627 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ccacacacuuguacauggctt

SEQ ID NO: 3628 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ggaugguggucacauagaatt

SEQ ID NO: 3629 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uacuucuuguggcagugcutt

SEQ ID NO: 3630 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gguacuucuuguggcagugtt

SEQ ID NO: 3631 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acagguacuucuuguggcatt

SEQ ID NO: 3632 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
aguuggagagguugccguatt

SEQ ID NO: 3633 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
caaagucacagaucuucactt

SEQ ID NO: 3634 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
aggccaaagucacagaucutt

SEQ ID NO: 3635 - DNA, 21 bp, Artificial Sequence
  Description of Artificial Sequence:  synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
  misc_feature (20)..(20): Phosphorothioate 3'-Internucleotide Linkage
ccacacacuuguacauggctt

SEQ ID NO: 3636 - DNA, 21 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(9): 2'-O-methyl
  misc_feature (10)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(15): 2'-deoxy-2'-fluoro
  misc_feature (16)..(19): 2'-O-methyl
  misc_feature (1)..(19): ribonucleotide modified as described
  misc_feature (20)..(20): Phosphorothioate 3'-Internucleotide Linkage
ggaugguggucacauagaatt

SEQ ID NO: 3637 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (14)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
  misc_feature (20)..(20): Phosphorothioate 3'-Internucleotide Linkage
uacuucuuguggcagugcutt

SEQ ID NO: 3638 - DNA, 21 bp, Artificial Sequence
  Description of Artificial Sequence:  synthetic
  misc_feature (1)..(2): 2'-O-methyl
  misc_feature (3)..(3): 2'-deoxy-2'-fluoro
  misc_feature (4)..(4): 2'-O-methyl
  misc_feature (5)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
  misc_feature (20)..(20): Phosphorothioate 3'-Internucleotide Linkage
gguacuucuuguggcagugtt

SEQ ID NO: 3639 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(5): 2'-O-methyl
  misc_feature (6)..(6): 2'-deoxy-2'-fluoro
  misc_feature (7)..(7): 2'-O-methyl
  misc_feature (8)..(13): 2'-deoxy-2'-fluoro
  misc_feature (14)..(14): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
  misc_feature (20)..(20): Phosphorothioate 3'-Internucleotide Linkage
acagguacuucuuguggcatt

SEQ ID NO: 3640 - DNA, 21 bp, Artificial Sequence
  Description of Artificial Sequence:  synthetic
  misc_feature (1)..(2): 2'-O-methyl
  misc_feature (3)..(4): 2'-deoxy-2'-fluoro
  misc_feature (5)..(11): 2'-O-methyl
  misc_feature (12)..(13): 2'-deoxy-2'-fluoro
  misc_feature (14)..(14): 2'-O-methyl
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
  misc_feature (20)..(20): Phosphorothioate 3'-Internucleotide Linkage
aguuggagagguugccguatt

SEQ ID NO: 3641 - DNA, 21 bp, Artificial Sequence
  Description of Artificial Sequence:  synthetic
  misc_feature (1)..(1): 2'-deoxy-2'-fluoro
  misc_feature (2)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(12): 2'-O-methyl
  misc_feature (13)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
caaagucacagaucuucactt

SEQ ID NO: 3642 - DNA, 21 bp, Artificial Sequence
  Description of Artificial Sequence:  synthetic
  misc_feature (1)..(3): 2'-O-methyl
  misc_feature (4)..(5): 2'-deoxy-2'-fluoro
  misc_feature (6)..(9): 2'-O-methyl
  misc_feature (10)..(11): 2'-deoxy-2'-fluoro
  misc_feature (12)..(12): 2'-O-methyl
  misc_feature (13)..(13): 2'-deoxy-2'-fluoro
  misc_feature (14)..(16): 2'-O-methyl
  misc_feature (17)..(19): 2'-deoxy-2'-fluoro
  misc_feature (1)..(19): ribonucleotide modified as described
  misc_feature (20)..(20): Phosphorothioate 3'-Internucleotide Linkage
aggccaaagucacagaucutt

SEQ ID NO: 3643 - DNA, 21 bp, Artificial Sequence
  Description of Artificial Sequence:  synthetic
  misc_feature (1)..(19): ribonucleotide modified as described
aagagcuccagagagaagutt

SEQ ID NO: 3644 - DNA, 21 bp, Artificial Sequence
  Description of Artificial Sequence:  synthetic
  misc_feature (1)..(19): ribonucleotide modified as described
aagugagugaccugcuuuutt

SEQ ID NO: 3645 - DNA, 21 bp, Artificial Sequence
  Description of Artificial Sequence:  synthetic
  misc_feature (1)..(19): ribonucleotide modified as described
gaaguggugaaguucauggtt

SEQ ID NO: 3646 - DNA, 21 bp, Artificial Sequence
  Description of Artificial Sequence:  synthetic
  misc_feature (1)..(19): ribonucleotide modified as described
uggacaucuuccaggaguatt

SEQ ID NO: 3647 - DNA, 21 bp, Artificial Sequence
  Description of Artificial Sequence:  synthetic
  misc_feature (1)..(19): ribonucleotide modified as described
ggacaucuuccaggaguactt

SEQ ID NO: 3648 - DNA, 21 bp, Artificial Sequence
  Description of Artificial Sequence:  synthetic
  misc_feature (1)..(19): ribonucleotide modified as described
acaucuuccaggaguaccctt

SEQ ID NO: 3649 - DNA, 21 bp, Artificial Sequence
  Description of Artificial Sequence:  synthetic
  misc_feature (1)..(19): ribonucleotide modified as described
uccaacaucaccaugcagatt

SEQ ID NO: 3650 - DNA, 21 bp, Artificial Sequence
  Description of Artificial Sequence:  synthetic
  misc_feature (1)..(19): ribonucleotide modified as described
aacguacuugcagaugugatt

SEQ ID NO: 3651 - DNA, 21 bp, Artificial Sequence
  Description of Artificial Sequence:  synthetic
  misc_feature (1)..(19): ribonucleotide modified as described
acuucucucuggagcucuutt

SEQ ID NO: 3652 - DNA, 21 bp, Artificial Sequence
  Description of Artificial Sequence:  synthetic
  misc_feature (1)..(19): ribonucleotide modified as described
aaaagcaggucacucacuutt

SEQ ID NO: 3653 - DNA, 21 bp, Artificial Sequence
  Description of Artificial Sequence:  synthetic
  misc_feature (1)..(19): ribonucleotide modified as described
ccaugaacuucaccacuuctt

SEQ ID NO: 3654 - DNA, 21 bp, Artificial Sequence
  Description of Artificial Sequence:  synthetic
  misc_feature (1)..(19): ribonucleotide modified as described
uacuccuggaagauguccatt

SEQ ID NO: 3655 - DNA, 21 bp, Artificial Sequence
  Description of Artificial Sequence:  synthetic
  misc_feature (1)..(19): ribonucleotide modified as described
guacuccuggaagaugucctt

SEQ ID NO: 3656 - DNA, 21 bp, Artificial Sequence
  Description of Artificial Sequence:  synthetic
  misc_feature (1)..(19): ribonucleotide modified as described
ggguacuccuggaagaugutt

SEQ ID NO: 3657 - DNA, 21 bp, Artificial Sequence
  Description of Artificial Sequence:  synthetic
  misc_feature (1)..(19): ribonucleotide modified as described
ucugcauggugauguuggatt

SEQ ID NO: 3658 - DNA, 21 bp, Artificial Sequence
  Description of Artificial Sequence:  synthetic
  misc_feature (1)..(19): ribonucleotide modified as described
ucacaucugcaaguacguutt

SEQ ID NO: 3659 - DNA, 21 bp, Artificial Sequence
  Description of Artificial Sequence:  synthetic
  misc_feature (1)..(1): 5'-3 attached terminal deoxyabasic moeity
  misc_feature (6)..(9): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aagagcuccagagagaagutt

SEQ ID NO: 3660 - DNA, 21 bp, Artificial Sequence
  Description of Artificial Sequence:  synthetic
  misc_feature (1)..(1): 5'-3 attached terminal deoxyabasic moeity
  misc_feature (4)..(4): 2'-deoxy-2'-fluoro
  misc_feature (8)..(8): 2'-deoxy-2'-fluoro
  misc_feature (11)..(13): 2'-deoxy-2'-fluoro
  misc_feature (15)..(19): 2'-deoxy-2'-fluoro
  misc_feature (1)..(19): ribonucleotide modified as described
  misc_feature (21)..(21): 3'-3 attached terminal deoxyabasic moeity
aagugagugaccugcuuuutt

SEQ ID NO: 3661 - DNA, 21 bp, Artificial Sequence
  Description of Artificial Sequence:  synthetic
  misc_feature (1)..(1): 5'-3 attached terminal deoxyabasic moeity
  misc_feature (5)..(5): 2'-deoxy-2'-fluoro
  misc_feature (8)..(8): 2'-deoxy-2'-fluoro
  misc_feature (13)..(15): 2'-deoxy-2'-fluoro
  misc_feature (17)..(17): 2'-deoxy-2'-fluoro
  misc_feature (1)..(19): ribonucleotide modified as described
  misc_feature (21)..(21): 3'-3 attached terminal deoxyabasic moeity
gaaguggugaaguucauggtt

SEQ ID NO: 3662 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (5)..(5): 2'-deoxy-2'-fluoro
  misc_feature (7)..(12): 2'-deoxy-2'-fluoro
  misc_feature (18)..(18): 2'-deoxy-2'-fluoro
  misc_feature (1)..(19): ribonucleotide modified as described
  misc_feature (21)..(21): 3'-3 attached terminal deoxyabasic moeity
uggacaucuuccaggaguatt

SEQ ID NO: 3663 - DNA, 21 bp, Artificial Sequence
  Description of Artificial Sequence:  synthetic
  misc_feature (1)..(1): 5'-3 attached terminal deoxyabasic moeity
  misc_feature (4)..(4): 2'-deoxy-2'-fluoro
  misc_feature (6)..(11): 2'-deoxy-2'-fluoro
  misc_feature (17)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggacaucuuccaggaguactt

SEQ ID NO: 3664 - DNA, 21 bp, Artificial Sequence
  Description of Artificial Sequence:  synthetic
  misc_feature (1)..(1): 5'-3 attached terminal deoxyabasic moeity
  misc_feature (2)..(2): 2'-deoxy-2'-fluoro
  misc_feature (4)..(9): 2'-deoxy-2'-fluoro
  misc_feature (15)..(15): 2'-deoxy-2'-fluoro
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
acaucuuccaggaguaccctt

SEQ ID NO: 3665 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (6)..(6): 2'-deoxy-2'-fluoro
  misc_feature (8)..(9): 2'-deoxy-2'-fluoro
  misc_feature (11)..(12): 2'-deoxy-2'-fluoro
  misc_feature (14)..(14): 2'-deoxy-2'-fluoro
  misc_feature (16)..(16): 2'-deoxy-2'-fluoro
  misc_feature (1)..(19): ribonucleotide modified as described
  misc_feature (21)..(21): 3'-3 attached terminal deoxyabasic moeity
uccaacaucaccaugcagatt

SEQ ID NO: 3666 - DNA, 21 bp, Artificial Sequence
  Description of Artificial Sequence:  synthetic
  misc_feature (1)..(1): 5'-3 attached terminal deoxyabasic moeity
  misc_feature (3)..(3): 2'-deoxy-2'-fluoro
  misc_feature (5)..(5): 2'-deoxy-2'-fluoro
  misc_feature (7)..(9): 2'-deoxy-2'-fluoro
  misc_feature (11)..(11): 2'-deoxy-2'-fluoro
  misc_feature (15)..(15): 2'-deoxy-2'-fluoro
  misc_feature (17)..(17): 2'-deoxy-2'-fluoro
  misc_feature (1)..(19): ribonucleotide modified as described
  misc_feature (21)..(21): 3'-3 attached terminal deoxyabasic moeity
aacguacuugcagaugugatt

SEQ ID NO: 3667 - DNA, 21 bp, Artificial Sequence
  Description of Artificial Sequence:  synthetic
  misc_feature (2)..(10): 2'-deoxy-2'-fluoro
  misc_feature (15)..(19): 2'-deoxy-2'-fluoro
  misc_feature (20)..(20): Phosphorothioate 3'-Internucleotide Linkage
  misc_feature (1)..(19): ribonucleotide modified as described
acuucucucuggagcucuutt

SEQ ID NO: 3668 - DNA, 21 bp, Artificial Sequence
  Description of Artificial Sequence:  synthetic
  misc_feature (6)..(6): 2'-deoxy-2'-fluoro
  misc_feature (10)..(11): 2'-deoxy-2'-fluoro
  misc_feature (13)..(15): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
aaaagcaggucacucacuutt

SEQ ID NO: 3669 - DNA, 21 bp, Artificial Sequence
  Description of Artificial Sequence:  synthetic
  misc_feature (1)..(2): 2'-deoxy-2'-fluoro
  misc_feature (4)..(4): 2'-deoxy-2'-fluoro
  misc_feature (8)..(11): 2'-deoxy-2'-fluoro
  misc_feature (13)..(14): 2'-deoxy-2'-fluoro
  misc_feature (16)..(19): 2'-deoxy-2'-fluoro
  misc_feature (20)..(20): Phosphorothioate 3'-Internucleotide Linkage
  misc_feature (1)..(19): ribonucleotide modified as described
ccaugaacuucaccacuuctt

SEQ ID NO: 3670 - DNA, 21 bp, Artificial Sequence
  Description of Artificial Sequence:  synthetic
  misc_feature (1)..(1): 2'-deoxy-2'-fluoro
  misc_feature (3)..(7): 2'-deoxy-2'-fluoro
  misc_feature (14)..(14): 2'-deoxy-2'-fluoro
  misc_feature (16)..(18): 2'-deoxy-2'-fluoro
  misc_feature (20)..(20): Phosphorothioate 3'-Internucleotide Linkage
  misc_feature (1)..(19): ribonucleotide modified as described
uacuccuggaagauguccatt

SEQ ID NO: 3671 - DNA, 21 bp, Artificial Sequence
  Description of Artificial Sequence:  synthetic
  misc_feature (2)..(2): 2'-deoxy-2'-fluoro
  misc_feature (4)..(8): 2'-deoxy-2'-fluoro
  misc_feature (15)..(15): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
guacuccuggaagaugucctt

SEQ ID NO: 3672 - DNA, 21 bp, Artificial Sequence
  Description of Artificial Sequence:  synthetic
  misc_feature (4)..(4): 2'-deoxy-2'-fluoro
  misc_feature (6)..(10): 2'-deoxy-2'-fluoro
  misc_feature (17)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ggguacuccuggaagaugutt

SEQ ID NO: 3673 - DNA, 21 bp, Artificial Sequence
  Description of Artificial Sequence:  synthetic
  misc_feature (1)..(3): 2'-deoxy-2'-fluoro
  misc_feature (5)..(5): 2'-deoxy-2'-fluoro
  misc_feature (7)..(7): 2'-deoxy-2'-fluoro
  misc_feature (10)..(10): 2'-deoxy-2'-fluoro
  misc_feature (13)..(13): 2'-deoxy-2'-fluoro
  misc_feature (15)..(16): 2'-deoxy-2'-fluoro
  misc_feature (20)..(20): Phosphorothioate 3'-Internucleotide Linkage
  misc_feature (1)..(19): ribonucleotide modified as described
ucugcauggugauguuggatt

SEQ ID NO: 3674 - DNA, 21 bp, Artificial Sequence
  Description of Artificial Sequence:  synthetic
  misc_feature (1)..(2): 2'-deoxy-2'-fluoro
  misc_feature (4)..(4): 2'-deoxy-2'-fluoro
  misc_feature (6)..(8): 2'-deoxy-2'-fluoro
  misc_feature (10)..(10): 2'-deoxy-2'-fluoro
  misc_feature (14)..(14): 2'-deoxy-2'-fluoro
  misc_feature (16)..(16): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
ucacaucugcaaguacguutt

SEQ ID NO: 3675 - DNA, 21 bp, Artificial Sequence
  Description of Artificial Sequence:  synthetic
  misc_feature (1)..(1): 5'-3 attached terminal deoxyabasic moeity
  misc_feature (1)..(5): 2'-deoxy
  misc_feature (6)..(9): 2'-deoxy-2'-fluoro
  misc_feature (10)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aagagcuccagagagaagutt

SEQ ID NO: 3676 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(7): 2'-deoxy
  misc_feature (8)..(8): 2'-deoxy-2'-fluoro
  misc_feature (9)..(10): 2'-deoxy
  misc_feature (11)..(13): 2'-deoxy-2'-fluoro
  misc_feature (14)..(14): 2'-deoxy
  misc_feature (15)..(19): 2'-deoxy-2'-fluoro
  misc_feature (1)..(19): ribonucleotide modified as described
  misc_feature (21)..(21): 3'-3 attached terminal deoxyabasic moeity
aagugagugaccugcuuuutt

SEQ ID NO: 3677 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
gaaguggugaaguucauggtt

SEQ ID NO: 3678 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(4): 2'-deoxy
  misc_feature (5)..(5): 2'-deoxy-2'-fluoro
  misc_feature (6)..(6): 2'-deoxy
  misc_feature (7)..(12): 2'-deoxy-2'-fluoro
  misc_feature (13)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
uggacaucuuccaggaguatt

SEQ ID NO: 3679 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy
  misc_feature (4)..(4): 2'-deoxy-2'-fluoro
  misc_feature (5)..(5): 2'-deoxy
  misc_feature (6)..(11): 2'-deoxy-2'-fluoro
  misc_feature (12)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggacaucuuccaggaguactt

SEQ ID NO: 3680 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(3): 2'-deoxy
  misc_feature (4)..(9): 2'-deoxy-2'-fluoro
  misc_feature (10)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
acaucuuccaggaguaccctt

SEQ ID NO: 3681 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (6)..(6): 2'-deoxy-2'-fluoro
  misc_feature (8)..(9): 2'-deoxy-2'-fluoro
  misc_feature (11)..(12): 2'-deoxy-2'-fluoro
  misc_feature (14)..(14): 2'-deoxy-2'-fluoro
  misc_feature (16)..(16): 2'-deoxy-2'-fluoro
  misc_feature (1)..(19): ribonucleotide modified as described
  misc_feature (21)..(21): 3'-3 attached terminal deoxyabasic moeity
uccaacaucaccaugcagatt

SEQ ID NO: 3682 - DNA, 21 bp, Artificial Sequence
  Description of Artificial Sequence:  synthetic
  misc_feature (1)..(2): 2'-deoxy
  misc_feature (1)..(1): 5'-3 attached terminal deoxyabasic moeity
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(9): 2'-deoxy-2'-fluoro
  misc_feature (10)..(10): 2'-deoxy
  misc_feature (11)..(11): 2'-deoxy-2'-fluoro
  misc_feature (12)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
aacguacuugcagaugugatt

SEQ ID NO: 3683 - DNA, 21 bp, Artificial Sequence
  Description of Artificial Sequence:  synthetic
  misc_feature (1)..(1): 2'-deoxy
  misc_feature (2)..(10): 2'-deoxy-2'-fluoro
  misc_feature (11)..(14): 2'-deoxy
  misc_feature (15)..(19): 2'-deoxy-2'-fluoro
  misc_feature (20)..(20): Phosphorothioate 3'-Internucleotide Linkage
  misc_feature (1)..(19): ribonucleotide modified as described
acuucucucuggagcucuutt

SEQ ID NO: 3684 - DNA, 21 bp, Artificial Sequence
  Description of Artificial Sequence:  synthetic
  misc_feature (1)..(5): 2'-deoxy
  misc_feature (6)..(6): 2'-deoxy-2'-fluoro
  misc_feature (7)..(9): 2'-deoxy
  misc_feature (10)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
aaaagcaggucacucacuutt

SEQ ID NO: 3685 - DNA, 21 bp, Artificial Sequence
  Description of Artificial Sequence:  synthetic
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(7): 2'-deoxy
  misc_feature (8)..(11): 2'-deoxy-2'-fluoro
  misc_feature (12)..(12): 2'-deoxy
  misc_feature (13)..(14): 2'-deoxy-2'-fluoro
  misc_feature (15)..(15): 2'-deoxy
  misc_feature (16)..(19): 2'-deoxy-2'-fluoro
  misc_feature (20)..(20): Phosphorothioate 3'-Internucleotide Linkage
  misc_feature (1)..(19): ribonucleotide modified as described
ccaugaacuucaccacuuctt

SEQ ID NO: 3686 - DNA, 21 bp, Artificial Sequence
  Description of Artificial Sequence:  synthetic
  misc_feature (1)..(1): 2'-deoxy-2'-fluoro
  misc_feature (2)..(2): 2'-deoxy
  misc_feature (3)..(7): 2'-deoxy-2'-fluoro
  misc_feature (8)..(13): 2'-deoxy
  misc_feature (14)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (20)..(20): Phosphorothioate 3'-Internucleotide Linkage
  misc_feature (1)..(19): ribonucleotide modified as described
uacuccuggaagauguccatt

SEQ ID NO: 3687 - DNA, 21 bp, Artificial Sequence
  Description of Artificial Sequence:  synthetic
  misc_feature (1)..(1): 2'-deoxy
  misc_feature (2)..(2): 2'-deoxy-2'-fluoro
  misc_feature (3)..(3): 2'-deoxy
  misc_feature (4)..(8): 2'-deoxy-2'-fluoro
  misc_feature (9)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
guacuccuggaagaugucctt

SEQ ID NO: 3688 - DNA, 21 bp, Artificial Sequence
  Description of Artificial Sequence:  synthetic
  misc_feature (1)..(3): 2'-deoxy
  misc_feature (4)..(4): 2'-deoxy-2'-fluoro
  misc_feature (5)..(5): 2'-deoxy
  misc_feature (6)..(10): 2'-deoxy-2'-fluoro
  misc_feature (11)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ggguacuccuggaagaugutt

SEQ ID NO: 3689 - DNA, 21 bp, Artificial Sequence
  Description of Artificial Sequence:  synthetic
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(19): 2'-deoxy
  misc_feature (20)..(20): Phosphorothioate 3'-Internucleotide Linkage
  misc_feature (1)..(19): ribonucleotide modified as described
ucugcauggugauguuggatt

SEQ ID NO: 3690 - DNA, 21 bp, Artificial Sequence
  Description of Artificial Sequence:  synthetic
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
ucacaucugcaaguacguutt

SEQ ID NO: 3691 - DNA, 21 bp, Artificial Sequence
  Description of Artificial Sequence:  synthetic
  misc_feature (1)..(1): 5'-3 attached terminal deoxyabasic moeity
  misc_feature (1)..(5): 2'-O-methyl
  misc_feature (6)..(9): 2'-deoxy-2'-fluoro
  misc_feature (10)..(18): 2'-O-methyl
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aagagcuccagagagaagutt

SEQ ID NO: 3692 - DNA, 21 bp, Artificial Sequence
  Description of Artificial Sequence:  synthetic
  misc_feature (1)..(3): 2'-O-methyl
  misc_feature (1)..(1): 5'-3 attached terminal deoxyabasic moeity
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(10): 2'-O-methyl
  misc_feature (11)..(13): 2'-deoxy-2'-fluoro
  misc_feature (14)..(14): 2'-O-methyl
  misc_feature (15)..(19): 2'-deoxy-2'-fluoro
  misc_feature (1)..(19): ribonucleotide modified as described
  misc_feature (21)..(21): 3'-3 attached terminal deoxyabasic moeity
aagugagugaccugcuuuutt

SEQ ID NO: 3693 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-O-methyl
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(12): 2'-O-methyl
  misc_feature (13)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
  misc_feature (21)..(21): 3'-3 attached terminal deoxyabasic moeity
gaaguggugaaguucauggtt

SEQ ID NO: 3694 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(4): 2'-O-methyl
  misc_feature (5)..(5): 2'-deoxy-2'-fluoro
  misc_feature (6)..(6): 2'-O-methyl
  misc_feature (7)..(12): 2'-deoxy-2'-fluoro
  misc_feature (13)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
  misc_feature (21)..(21): 5'-3 attached terminal deoxyabasic moeity
uggacaucuuccaggaguatt

SEQ ID NO: 3695 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-O-methyl
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggacaucuuccaggaguactt

SEQ ID NO: 3696 - DNA, 21 bp, Artificial Sequence
  Description of Artificial Sequence:  synthetic
  misc_feature (1)..(1): 2'-O-methyl
  misc_feature (1)..(1): 5'-3 attached terminal deoxyabasic moeity
  misc_feature (2)..(2): 2'-deoxy-2'-fluoro
  misc_feature (3)..(3): 2'-O-methyl
  misc_feature (4)..(9): 2'-deoxy-2'-fluoro
  misc_feature (10)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
acaucuuccaggaguaccctt

SEQ ID NO: 3697 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy-2'-fluoro
  misc_feature (4)..(5): 2'-O-methyl
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (17)..(19): 2'-O-methyl
  misc_feature (1)..(19): ribonucleotide modified as described
  misc_feature (21)..(21): 3'-3 attached terminal deoxyabasic moeity
  misc_feature (116)..(16): 2'-deoxy-2'-fluoro
uccaacaucaccaugcagatt

SEQ ID NO: 3698 - DNA, 21 bp, Artificial Sequence
  Description of Artificial Sequence:  synthetic
  misc_feature (1)..(2): 2'-O-methyl
  misc_feature (1)..(1): 5'-3 attached terminal deoxyabasic moeity
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(10): 2'-O-methyl
  misc_feature (11)..(11): 2'-deoxy-2'-fluoro
  misc_feature (12)..(14): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
  misc_feature (21)..(21): 3'-3 attached terminal deoxyabasic moeity
aacguacuugcagaugugatt

SEQ ID NO: 3699 - DNA, 21 bp, Artificial Sequence
  Description of Artificial Sequence:  synthetic
  misc_feature (1)..(1): 2'-O-methyl
  misc_feature (2)..(10): 2'-deoxy-2'-fluoro
  misc_feature (11)..(14): 2'-O-methyl
  misc_feature (15)..(19): 2'-deoxy-2'-fluoro
  misc_feature (20)..(20): Phosphorothioate 3'-Internucleotide Linkage
  misc_feature (1)..(19): ribonucleotide modified as described
acuucucucuggagcucuutt

SEQ ID NO: 3700 - DNA, 21 bp, Artificial Sequence
  Description of Artificial Sequence:  synthetic
  misc_feature (1)..(5): 2'-O-methyl
  misc_feature (6)..(6): 2'-deoxy-2'-fluoro
  misc_feature (7)..(9): 2'-O-methyl
  misc_feature (10)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
aaaagcaggucacucacuutt

SEQ ID NO: 3701 - DNA, 21 bp, Artificial Sequence
  Description of Artificial Sequence:  synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(7): 2'-O-methyl
  misc_feature (8)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(19): 2'-deoxy-2'-fluoro
  misc_feature (20)..(20): Phosphorothioate 3'-Internucleotide Linkage
  misc_feature (1)..(19): ribonucleotide modified as described
ccaugaacuucaccacuuctt

SEQ ID NO: 3702 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(7): 2'-deoxy-2'-fluoro
  misc_feature (8)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
uacuccuggaagauguccatt

SEQ ID NO: 3703 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(3): 2'-O-methyl
  misc_feature (4)..(8): 2'-deoxy-2'-fluoro
  misc_feature (9)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
guacuccuggaagaugucctt

SEQ ID NO: 3704 - DNA, 21 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
ggguacuccuggaagaugutt

SEQ ID NO: 3705 - DNA, 21 bp, Artificial Sequence
  Description of Artificial Sequence:  synthetic
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (14)..(14): 2'-O-methyl
  misc_feature (15)..(16): 2'-deoxy-2'-fluoro
  misc_feature (17)..(19): 2'-O-methyl
  misc_feature (20)..(20): Phosphorothioate 3'-Internucleotide Linkage
  misc_feature (1)..(19): ribonucleotide modified as described
ucugcauggugauguuggatt

SEQ ID NO: 3706 - DNA, 21 bp, Artificial Sequence
  Description of Artificial Sequence:  synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(20): Phosphorothioate 3'-Internucleotide Linkage
  misc_feature (1)..(19): ribonucleotide modified as described
ucacaucugcaaguacguutt

SEQ ID NO: 3707 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
aagagcuccagagagaagutt

SEQ ID NO: 3708 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
aagugagugaccugcuuuutt

SEQ ID NO: 3709 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
gaaguggugaaguucauggtt

SEQ ID NO: 3710 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
uggacaucuuccaggaguatt

SEQ ID NO: 3711 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
ggacaucuuccaggaguactt

SEQ ID NO: 3712 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
acaucuuccaggaguaccctt

SEQ ID NO: 3713 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
uccaacaucaccaugcagatt

SEQ ID NO: 3714 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
aacguacuugcagaugugatt

SEQ ID NO: 3715 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acuucucucuggagcucuutt

SEQ ID NO: 3716 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
aaaagcaggucacucacuutt

SEQ ID NO: 3717 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ccaugaacuucaccacuuctt

SEQ ID NO: 3718 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uacuccuggaagauguccatt

SEQ ID NO: 3719 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
guacuccuggaagaugucctt

SEQ ID NO: 3720 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ggguacuccuggaagaugutt

SEQ ID NO: 3721 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ucugcauggugauguuggatt

SEQ ID NO: 3722 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ucacaucugcaaguacguutt

SEQ ID NO: 3723 - DNA, 21 bp, Artificial Sequence
  Description of Artificial Sequence:  synthetic
  misc_feature (2)..(10): 2'-deoxy-2'-fluoro
  misc_feature (15)..(19): 2'-deoxy-2'-fluoro
  misc_feature (1)..(19): ribonucleotide modified as described
  misc_feature (21)..(21): 3'-3 attached terminal deoxyabasic moeity
acuucucucuggagcucuutt

SEQ ID NO: 3724 - DNA, 21 bp, Artificial Sequence
  Description of Artificial Sequence:  synthetic
  misc_feature (6)..(6): 2'-deoxy-2'-fluoro
  misc_feature (10)..(11): 2'-deoxy-2'-fluoro
  misc_feature (13)..(15): 2'-deoxy-2'-fluoro
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
aaaagcaggucacucacuutt

SEQ ID NO: 3725 - DNA, 21 bp, Artificial Sequence
  Description of Artificial Sequence:  synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(7): 2'-O-methyl
  misc_feature (8)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(19): 2'-deoxy-2'-fluoro
  misc_feature (1)..(19): ribonucleotide modified as described
  misc_feature (21)..(21): 3'-3 attached terminal deoxyabasic moeity
ccaugaacuucaccacuuctt

SEQ ID NO: 3726 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(7): 2'-deoxy-2'-fluoro
  misc_feature (8)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
  misc_feature (21)..(21): 3'-3 attached terminal deoxyabasic moeity
uacuccuggaagauguccatt

SEQ ID NO: 3727 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(3): 2'-O-methyl
  misc_feature (4)..(8): 2'-deoxy-2'-fluoro
  misc_feature (9)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
guacuccuggaagaugucctt

SEQ ID NO: 3728 - DNA, 21 bp, Artificial Sequence
  Description of Artificial Sequence:  synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ggguacuccuggaagaugutt

SEQ ID NO: 3729 - DNA, 21 bp, Artificial Sequence
  Description of Artificial Sequence:  synthetic
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (14)..(14): 2'-O-methyl
  misc_feature (15)..(16): 2'-deoxy-2'-fluoro
  misc_feature (17)..(19): 2'-O-methyl
  misc_feature (1)..(19): ribonucleotide modified as described
  misc_feature (21)..(21): 3'-3 attached terminal deoxyabasic moeity
ucugcauggugauguuggatt

SEQ ID NO: 3730 - DNA, 21 bp, Artificial Sequence
  Description of Artificial Sequence:  synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
ucacaucugcaaguacguutt

SEQ ID NO: 3731 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
acuucucucuggagcucuutt

SEQ ID NO: 3732 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
aaaagcaggucacucacuutt

SEQ ID NO: 3733 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
ccaugaacuucaccacuuctt

SEQ ID NO: 3734 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
uacuccuggaagauguccatt

SEQ ID NO: 3735 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
guacuccuggaagaugucctt

SEQ ID NO: 3736 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
ggguacuccuggaagaugutt

SEQ ID NO: 3737 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
ucugcauggugauguuggatt

SEQ ID NO: 3738 - DNA, 21 bp, Artificial Sequence
  Description of Artificial Sequence:  synthetic
  misc_feature (1)..(19): ribonucleotide modified as described
  misc_feature (21)..(21): 3'-3 attached terminal deoxyabasic moeity
ucacaucugcaaguacguutt

SEQ ID NO: 3739 - DNA, 21 bp, Artificial Sequence
  Description of Artificial Sequence:  synthetic
  misc_feature (1)..(19): ribonucleotide modified as described
acccugguggacaucuucctt

SEQ ID NO: 3740 - DNA, 21 bp, Artificial Sequence
  Description of Artificial Sequence:  synthetic
  misc_feature (1)..(19): ribonucleotide modified as described
ugcggaucaaaccucaccatt

SEQ ID NO: 3741 - DNA, 21 bp, Artificial Sequence
  Description of Artificial Sequence:  synthetic
  misc_feature (1)..(19): ribonucleotide modified as described
augugaaugcagaccaaagtt

SEQ ID NO: 3742 - DNA, 21 bp, Artificial Sequence
  Description of Artificial Sequence:  synthetic
  misc_feature (1)..(19): ribonucleotide modified as described
ugugaaugcagaccaaagatt

SEQ ID NO: 3743 - DNA, 21 bp, Artificial Sequence
  Description of Artificial Sequence:  synthetic
  misc_feature (1)..(19): ribonucleotide modified as described
gugaaugcagaccaaagaatt

SEQ ID NO: 3744 - DNA, 21 bp, Artificial Sequence
  Description of Artificial Sequence:  synthetic
  misc_feature (1)..(19): ribonucleotide modified as described
gaaugcagaccaaagaaagtt

SEQ ID NO: 3745 - DNA, 21 bp, Artificial Sequence
  Description of Artificial Sequence:  synthetic
  misc_feature (1)..(19): ribonucleotide modified as described
gacguguaaauguuccugctt

SEQ ID NO: 3746 - DNA, 21 bp, Artificial Sequence
  Description of Artificial Sequence:  synthetic
  misc_feature (1)..(19): ribonucleotide modified as described
uguaaauguuccugcaaaatt

SEQ ID NO: 3747 - DNA, 21 bp, Artificial Sequence
  Description of Artificial Sequence:  synthetic
  misc_feature (1)..(19): ribonucleotide modified as described
guaaauguuccugcaaaaatt

SEQ ID NO: 3748 - DNA, 21 bp, Artificial Sequence
  Description of Artificial Sequence:  synthetic
  misc_feature (1)..(19): ribonucleotide modified as described
uaaauguuccugcaaaaactt

SEQ ID NO: 3749 - DNA, 21 bp, Artificial Sequence
  Description of Artificial Sequence:  synthetic
  misc_feature (1)..(19): ribonucleotide modified as described
aaauguuccugcaaaaacatt

SEQ ID NO: 3750 - DNA, 21 bp, Artificial Sequence
  Description of Artificial Sequence:  synthetic
  misc_feature (1)..(19): ribonucleotide modified as described
gcaaaaacacagacucgcgtt

SEQ ID NO: 3751 - DNA, 21 bp, Artificial Sequence
  Description of Artificial Sequence:  synthetic
  misc_feature (1)..(19): ribonucleotide modified as described
agcuugaguuaaacgaacgtt

SEQ ID NO: 3752 - DNA, 21 bp, Artificial Sequence
  Description of Artificial Sequence:  synthetic
  misc_feature (1)..(19): ribonucleotide modified as described
uacuugcagaugugacaagtt

SEQ ID NO: 3753 - DNA, 21 bp, Artificial Sequence
  Description of Artificial Sequence:  synthetic
  misc_feature (1)..(19): ribonucleotide modified as described
ggaagauguccaccagggutt

SEQ ID NO: 3754 - DNA, 21 bp, Artificial Sequence
  Description of Artificial Sequence:  synthetic
  misc_feature (1)..(19): ribonucleotide modified as described
uggugagguuugauccgcatt

SEQ ID NO: 3755 - DNA, 21 bp, Artificial Sequence
  Description of Artificial Sequence:  synthetic
  misc_feature (1)..(19): ribonucleotide modified as described
cuuuggucugcauucacautt

SEQ ID NO: 3756 - DNA, 21 bp, Artificial Sequence
  Description of Artificial Sequence:  synthetic
  misc_feature (1)..(19): ribonucleotide modified as described
ucuuuggucugcauucacatt

SEQ ID NO: 3757 - DNA, 21 bp, Artificial Sequence
  Description of Artificial Sequence:  synthetic
  misc_feature (1)..(19): ribonucleotide modified as described
uucuuuggucugcauucactt

SEQ ID NO: 3758 - DNA, 21 bp, Artificial Sequence
  Description of Artificial Sequence:  synthetic
  misc_feature (1)..(19): ribonucleotide modified as described
cuuucuuuggucugcauuctt

SEQ ID NO: 3759 - DNA, 21 bp, Artificial Sequence
  Description of Artificial Sequence:  synthetic
  misc_feature (1)..(19): ribonucleotide modified as described
gcaggaacauuuacacguctt

SEQ ID NO: 3760 - DNA, 21 bp, Artificial Sequence
  Description of Artificial Sequence:  synthetic
  misc_feature (1)..(19): ribonucleotide modified as described
uuuugcaggaacauuuacatt

SEQ ID NO: 3761 - DNA, 21 bp, Artificial Sequence
  Description of Artificial Sequence:  synthetic
  misc_feature (1)..(19): ribonucleotide modified as described
uuuuugcaggaacauuuactt

SEQ ID NO: 3762 - DNA, 21 bp, Artificial Sequence
  Description of Artificial Sequence:  synthetic
  misc_feature (1)..(19): ribonucleotide modified as described
guuuuugcaggaacauuuatt

SEQ ID NO: 3763 - DNA, 21 bp, Artificial Sequence
  Description of Artificial Sequence:  synthetic
  misc_feature (1)..(19): ribonucleotide modified as described
uguuuuugcaggaacauuutt

SEQ ID NO: 3764 - DNA, 21 bp, Artificial Sequence
  Description of Artificial Sequence:  synthetic
  misc_feature (1)..(19): ribonucleotide modified as described
cgcgagucuguguuuuugctt

SEQ ID NO: 3765 - DNA, 21 bp, Artificial Sequence
  Description of Artificial Sequence:  synthetic
  misc_feature (1)..(19): ribonucleotide modified as described
cguucguuuaacucaagcutt

SEQ ID NO: 3766 - DNA, 21 bp, Artificial Sequence
  Description of Artificial Sequence:  synthetic
  misc_feature (1)..(19): ribonucleotide modified as described
cuugucacaucugcaaguatt

SEQ ID NO: 3767 - DNA, 21 bp, Artificial Sequence
  Description of Artificial Sequence:  synthetic
  misc_feature (1)..(19): ribonucleotide modified as described
gacccugguggacaucuuctt

SEQ ID NO: 3768 - DNA, 21 bp, Artificial Sequence
  Description of Artificial Sequence:  synthetic
  misc_feature (1)..(19): ribonucleotide modified as described
cccugguggacaucuuccatt

SEQ ID NO: 3769 - DNA, 21 bp, Artificial Sequence
  Description of Artificial Sequence:  synthetic
  misc_feature (1)..(19): ribonucleotide modified as described
agagcggagaaagcauuugtt

SEQ ID NO: 3770 - DNA, 21 bp, Artificial Sequence
  Description of Artificial Sequence:  synthetic
  misc_feature (1)..(19): ribonucleotide modified as described
ccgcagacguguaaauguutt

SEQ ID NO: 3771 - DNA, 21 bp, Artificial Sequence
  Description of Artificial Sequence:  synthetic
  misc_feature (1)..(19): ribonucleotide modified as described
gcagacguguaaauguucctt

SEQ ID NO: 3772 - DNA, 21 bp, Artificial Sequence
  Description of Artificial Sequence:  synthetic
  misc_feature (1)..(19): ribonucleotide modified as described
cagacguguaaauguuccutt

SEQ ID NO: 3773 - DNA, 21 bp, Artificial Sequence
  Description of Artificial Sequence:  synthetic
  misc_feature (1)..(19): ribonucleotide modified as described
cguguaaauguuccugcaatt

SEQ ID NO: 3774 - DNA, 21 bp, Artificial Sequence
  Description of Artificial Sequence:  synthetic
  misc_feature (1)..(19): ribonucleotide modified as described
aauguuccugcaaaaacactt

SEQ ID NO: 3775 - DNA, 21 bp, Artificial Sequence
  Description of Artificial Sequence:  synthetic
  misc_feature (1)..(19): ribonucleotide modified as described
auguuccugcaaaaacacatt

SEQ ID NO: 3776 - DNA, 21 bp, Artificial Sequence
  Description of Artificial Sequence:  synthetic
  misc_feature (1)..(19): ribonucleotide modified as described
cugcaaaaacacagacucgtt

SEQ ID NO: 3777 - DNA, 21 bp, Artificial Sequence
  Description of Artificial Sequence:  synthetic
  misc_feature (1)..(19): ribonucleotide modified as described
ugcaaaaacacagacucgctt

SEQ ID NO: 3778 - DNA, 21 bp, Artificial Sequence
  Description of Artificial Sequence:  synthetic
  misc_feature (1)..(19): ribonucleotide modified as described
gcgaggcagcuugaguuaatt

SEQ ID NO: 3779 - DNA, 21 bp, Artificial Sequence
  Description of Artificial Sequence:  synthetic
  misc_feature (1)..(19): ribonucleotide modified as described
aggcagcuugaguuaaacgtt

SEQ ID NO: 3780 - DNA, 21 bp, Artificial Sequence
  Description of Artificial Sequence:  synthetic
  misc_feature (1)..(19): ribonucleotide modified as described
ggcagcuugaguuaaacgatt

SEQ ID NO: 3781 - DNA, 21 bp, Artificial Sequence
  Description of Artificial Sequence:  synthetic
  misc_feature (1)..(19): ribonucleotide modified as described
gcagcuugaguuaaacgaatt

SEQ ID NO: 3782 - DNA, 21 bp, Artificial Sequence
  Description of Artificial Sequence:  synthetic
  misc_feature (1)..(19): ribonucleotide modified as described
cagcuugaguuaaacgaactt

SEQ ID NO: 3783 - DNA, 21 bp, Artificial Sequence
  Description of Artificial Sequence:  synthetic
  misc_feature (1)..(19): ribonucleotide modified as described
aacgaacguacuugcagautt

SEQ ID NO: 3784 - DNA, 21 bp, Artificial Sequence
  Description of Artificial Sequence:  synthetic
  misc_feature (1)..(19): ribonucleotide modified as described
acgaacguacuugcagaugtt

SEQ ID NO: 3785 - DNA, 21 bp, Artificial Sequence
  Description of Artificial Sequence:  synthetic
  misc_feature (1)..(19): ribonucleotide modified as described
gaagauguccaccaggguctt

SEQ ID NO: 3786 - DNA, 21 bp, Artificial Sequence
  Description of Artificial Sequence:  synthetic
  misc_feature (1)..(19): ribonucleotide modified as described
uggaagauguccaccagggtt

SEQ ID NO: 3787 - DNA, 21 bp, Artificial Sequence
  Description of Artificial Sequence:  synthetic
  misc_feature (1)..(19): ribonucleotide modified as described
caaaugcuuucuccgcucutt

SEQ ID NO: 3788 - DNA, 21 bp, Artificial Sequence
  Description of Artificial Sequence:  synthetic
  misc_feature (1)..(19): ribonucleotide modified as described
aacauuuacacgucugcggtt

SEQ ID NO: 3789 - DNA, 21 bp, Artificial Sequence
  Description of Artificial Sequence:  synthetic
  misc_feature (1)..(19): ribonucleotide modified as described
ggaacauuuacacgucugctt

SEQ ID NO: 3790 - DNA, 21 bp, Artificial Sequence
  Description of Artificial Sequence:  synthetic
  misc_feature (1)..(19): ribonucleotide modified as described
aggaacauuuacacgucugtt

SEQ ID NO: 3791 - DNA, 21 bp, Artificial Sequence
  Description of Artificial Sequence:  synthetic
  misc_feature (1)..(19): ribonucleotide modified as described
uugcaggaacauuuacacgtt

SEQ ID NO: 3792 - DNA, 21 bp, Artificial Sequence
  Description of Artificial Sequence:  synthetic
  misc_feature (1)..(19): ribonucleotide modified as described
guguuuuugcaggaacauutt

SEQ ID NO: 3793 - DNA, 21 bp, Artificial Sequence
  Description of Artificial Sequence:  synthetic
  misc_feature (1)..(19): ribonucleotide modified as described
uguguuuuugcaggaacautt

SEQ ID NO: 3794 - DNA, 21 bp, Artificial Sequence
  Description of Artificial Sequence:  synthetic
  misc_feature (1)..(19): ribonucleotide modified as described
cgagucuguguuuuugcagtt

SEQ ID NO: 3795 - DNA, 21 bp, Artificial Sequence
  Description of Artificial Sequence:  synthetic
  misc_feature (1)..(19): ribonucleotide modified as described
gcgagucuguguuuuugcatt

SEQ ID NO: 3796 - DNA, 21 bp, Artificial Sequence
  Description of Artificial Sequence:  synthetic
  misc_feature (1)..(19): ribonucleotide modified as described
uuaacucaagcugccucgctt

SEQ ID NO: 3797 - DNA, 21 bp, Artificial Sequence
  Description of Artificial Sequence:  synthetic
  misc_feature (1)..(19): ribonucleotide modified as described
cguuuaacucaagcugccutt

SEQ ID NO: 3798 - DNA, 21 bp, Artificial Sequence
  Description of Artificial Sequence:  synthetic
  misc_feature (1)..(19): ribonucleotide modified as described
ucguuuaacucaagcugcctt

SEQ ID NO: 3799 - DNA, 21 bp, Artificial Sequence
  Description of Artificial Sequence:  synthetic
  misc_feature (1)..(19): ribonucleotide modified as described
uucguuuaacucaagcugctt

SEQ ID NO: 3800 - DNA, 21 bp, Artificial Sequence
  Description of Artificial Sequence:  synthetic
  misc_feature (1)..(19): ribonucleotide modified as described
guucguuuaacucaagcugtt

SEQ ID NO: 3801 - DNA, 21 bp, Artificial Sequence
  Description of Artificial Sequence:  synthetic
  misc_feature (1)..(19): ribonucleotide modified as described
aucugcaaguacguucguutt

SEQ ID NO: 3802 - DNA, 21 bp, Artificial Sequence
  Description of Artificial Sequence:  synthetic
  misc_feature (1)..(19): ribonucleotide modified as described
caucugcaaguacguucgutt

SEQ ID NO: 3803 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(8): 2'-deoxy-2'-fluoro
  misc_feature (9)..(11): 2'-deoxy
  misc_feature (12)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
ugcggaucaaaccucaccatt

SEQ ID NO: 3804 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(13): 2'-deoxy
  misc_feature (14)..(15): 2'-deoxy-2'-fluoro
  misc_feature (16)..(19): 2'-deoxy
  misc_feature (1)..(19): ribonucleotide modified as described
  misc_feature (21)..(21): 3'-3 attached terminal deoxyabasic moeity
augugaaugcagaccaaagtt

SEQ ID NO: 3805 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(11): 2'-deoxy
  misc_feature (12)..(13): 2'-deoxy-2'-fluoro
  misc_feature (14)..(19): 2'-deoxy
  misc_feature (1)..(19): ribonucleotide modified as described
  misc_feature (21)..(21): 3'-3 attached terminal deoxyabasic moeity
gugaaugcagaccaaagaatt

SEQ ID NO: 3806 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(3): 2'-deoxy
  misc_feature (4)..(8): 2'-deoxy-2'-fluoro
  misc_feature (9)..(9): 2'-deoxy
  misc_feature (10)..(10): 2'-deoxy-2'-fluoro
  misc_feature (11)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
auguuccugcaaaaacacatt

SEQ ID NO: 3807 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(3): 2'-deoxy
  misc_feature (4)..(6): 2'-deoxy-2'-fluoro
  misc_feature (7)..(9): 2'-deoxy
  misc_feature (10)..(11): 2'-deoxy-2'-fluoro
  misc_feature (12)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cagcuugaguuaaacgaactt

SEQ ID NO: 3808 - DNA, 21 bp, Artificial Sequence
  Description of Artificial Sequence:  synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(8): 2'-O-methyl
  misc_feature (9)..(11): 2'-deoxy-2'-fluoro
  misc_feature (12)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
uggugagguuugauccgcatt

SEQ ID NO: 3809 - DNA, 21 bp, Artificial Sequence
  Description of Artificial Sequence:  synthetic
  misc_feature (1)..(4): 2'-deoxy-2'-fluoro
  misc_feature (5)..(6): 2'-O-methyl
  misc_feature (7)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
cuuuggucugcauucacautt

SEQ ID NO: 3810 - DNA, 21 bp, Artificial Sequence
  Description of Artificial Sequence:  synthetic
  misc_feature (1)..(6): 2'-deoxy-2'-fluoro
  misc_feature (7)..(8): 2'-O-methyl
  misc_feature (9)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
uucuuuggucugcauucactt

SEQ ID NO: 3811 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (5)..(9): 2'-deoxy-2'-fluoro
  misc_feature (10)..(10): 2'-O-methyl
  misc_feature (11)..(11): 2'-deoxy-2'-fluoro
  misc_feature (12)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
uguguuuuugcaggaacautt

SEQ ID NO: 3812 - DNA, 21 bp, Artificial Sequence
  Description of Artificial Sequence:  synthetic
  misc_feature (1)..(1): 2'-O-methyl
  misc_feature (2)..(4): 2'-deoxy-2'-fluoro
  misc_feature (5)..(5): 2'-O-methyl
  misc_feature (6)..(8): 2'-deoxy-2'-fluoro
  misc_feature (9)..(10): 2'-O-methyl
  misc_feature (11)..(13): 2'-deoxy-2'-fluoro
  misc_feature (14)..(16): 2'-O-methyl
  misc_feature (17)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
guucguuuaacucaagcugtt

SEQ ID NO: 3813 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
ugcggaucaaaccucaccatt

SEQ ID NO: 3814 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
augugaaugcagaccaaagtt

SEQ ID NO: 3815 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
gugaaugcagaccaaagaatt

SEQ ID NO: 3816 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
auguuccugcaaaaacacatt

SEQ ID NO: 3817 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
cagcuugaguuaaacgaactt

SEQ ID NO: 3818 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uggugagguuugauccgcatt

SEQ ID NO: 3819 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cuuuggucugcauucacautt

SEQ ID NO: 3820 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uucuuuggucugcauucactt

SEQ ID NO: 3821 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uguguuuuugcaggaacautt

SEQ ID NO: 3822 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
guucguuuaacucaagcugtt

SEQ ID NO: 3823 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(3): 2'-deoxy-2'-fluoro
  misc_feature (4)..(4): 2'-deoxy
  misc_feature (5)..(8): 2'-deoxy-2'-fluoro
  misc_feature (9)..(11): 2'-deoxy
  misc_feature (12)..(13): 2'-deoxy-2'-fluoro
  misc_feature (14)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
accacuccaaacuaggcgutt

SEQ ID NO: 3824 - DNA, 21 bp, Artificial Sequence
  Description of Artificial Sequence:  synthetic
  misc_feature (1)..(4): 2'-deoxy
  misc_feature (1)..(1): 5'-3 attached terminal deoxyabasic moeity
  misc_feature (5)..(6): 2'-deoxy-2'-fluoro
  misc_feature (7)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
gaaaccagacguaaguguatt

SEQ ID NO: 3825 - DNA, 21 bp, Artificial Sequence
  Description of Artificial Sequence:  synthetic
  misc_feature (1)..(1): 5'-3 attached terminal deoxyabasic moeity
  misc_feature (1)..(6): 2'-deoxy
  misc_feature (7)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aagaaaccagacguaagugtt

SEQ ID NO: 3826 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(9): 2'-deoxy
  misc_feature (10)..(10): 2'-deoxy-2'-fluoro
  misc_feature (11)..(11): 2'-deoxy
  misc_feature (12)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
acacaaaaacguccuuguatt

SEQ ID NO: 3827 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(8): 2'-deoxy
  misc_feature (9)..(10): 2'-deoxy-2'-fluoro
  misc_feature (11)..(13): 2'-deoxy
  misc_feature (14)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
caagcaaauugaguucgactt

SEQ ID NO: 3828 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(3): 2'-O-methyl
  misc_feature (4)..(6): 2'-deoxy-2'-fluoro
  misc_feature (7)..(8): 2'-O-methyl
  misc_feature (9)..(11): 2'-deoxy-2'-fluoro
  misc_feature (12)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
acgccuaguuuggaguggutt

SEQ ID NO: 3829 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(13): 2'-deoxy-2'-fluoro
  misc_feature (14)..(15): 2'-O-methyl
  misc_feature (16)..(19): 2'-deoxy-2'-fluoro
  misc_feature (20)..(20): Phosphorothioate 3'-Internucleotide Linkage
  misc_feature (1)..(19): ribonucleotide modified as described
uacacuuacgucugguuuctt

SEQ ID NO: 3830 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(13): 2'-O-methyl
  misc_feature (14)..(19): 2'-deoxy-2'-fluoro
  misc_feature (20)..(20): Phosphorothioate 3'-Internucleotide Linkage
  misc_feature (1)..(19): ribonucleotide modified as described
cacuuacgucugguuucuutt

SEQ ID NO: 3831 - DNA, 21 bp, Artificial Sequence
  Description of Artificial Sequence:  synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(8): 2'-O-methyl
  misc_feature (9)..(9): 2'-deoxy-2'-fluoro
  misc_feature (10)..(10): 2'-O-methyl
  misc_feature (11)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
uacaaggacguuuuugugutt

SEQ ID NO: 3832 - DNA, 21 bp, Artificial Sequence
  Description of Artificial Sequence:  synthetic
  misc_feature (1)..(1): 2'-O-methyl
  misc_feature (2)..(3): 2'-deoxy-2'-fluoro
  misc_feature (4)..(6): 2'-O-methyl
  misc_feature (7)..(9): 2'-deoxy-2'-fluoro
  misc_feature (10)..(11): 2'-O-methyl
  misc_feature (12)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
gucgaacucaauuugcuugtt

SEQ ID NO: 3833 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
accacuccaaacuaggcgutt

SEQ ID NO: 3834 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
gaaaccagacguaaguguatt

SEQ ID NO: 3835 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
aagaaaccagacguaagugtt

SEQ ID NO: 3836 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
acacaaaaacguccuuguatt

SEQ ID NO: 3837 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
caagcaaauugaguucgactt

SEQ ID NO: 3838 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acgccuaguuuggaguggutt

SEQ ID NO: 3839 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uacacuuacgucugguuuctt

SEQ ID NO: 3840 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cacuuacgucugguuucuutt

SEQ ID NO: 3841 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uacaaggacguuuuugugutt

SEQ ID NO: 3842 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gucgaacucaauuugcuugtt

SEQ ID NO: 3843 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
ugugaaugcagaccaaagatt

SEQ ID NO: 3844 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
gaaugcagaccaaagaaagtt

SEQ ID NO: 3845 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ucuuuggucugcauucacatt

SEQ ID NO: 3846 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cuuucuuuggucugcauuctt

SEQ ID NO: 3847 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(12): 2'-deoxy
  misc_feature (13)..(14): 2'-deoxy-2'-fluoro
  misc_feature (15)..(19): 2'-deoxy
  misc_feature (1)..(19): ribonucleotide modified as described
  misc_feature (21)..(21): 3'-3 attached terminal deoxyabasic moeity
ugugaaugcagaccaaagatt

SEQ ID NO: 3848 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(9): 2'-deoxy
  misc_feature (10)..(11): 2'-deoxy-2'-fluoro
  misc_feature (12)..(19): 2'-deoxy
  misc_feature (1)..(19): ribonucleotide modified as described
  misc_feature (21)..(21): 3'-3 attached terminal deoxyabasic moeity
gaaugcagaccaaagaaagtt

SEQ ID NO: 3849 - DNA, 21 bp, Artificial Sequence
  Description of Artificial Sequence:  synthetic
  misc_feature (1)..(5): 2'-deoxy-2'-fluoro
  misc_feature (6)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
ucuuuggucugcauucacatt

SEQ ID NO: 3850 - DNA, 21 bp, Artificial Sequence
  Description of Artificial Sequence:  synthetic
  misc_feature (1)..(8): 2'-deoxy-2'-fluoro
  misc_feature (9)..(10): 2'-O-methyl
  misc_feature (11)..(13): 2'-deoxy-2'-fluoro
  misc_feature (14)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide modified as described
cuuucuuuggucugcauuctt

SEQ ID NO: 3851 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
augaggaccuucuacaggutt

SEQ ID NO: 3852 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
caugaggaccuucuacaggtt

SEQ ID NO: 3853 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
agaaaccagacguaagugutt

SEQ ID NO: 3854 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
gaaagaaaccagacguaagtt

SEQ ID NO: 3855 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
accuguagaagguccucautt

SEQ ID NO: 3856 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
ccuguagaagguccucaugtt

SEQ ID NO: 3857 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
acacuuacgucugguuucutt

SEQ ID NO: 3858 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
cuuacgucugguuucuuuctt

SEQ ID NO: 3859 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(7): 2'-deoxy
  misc_feature (8)..(13): 2'-deoxy-2'-fluoro
  misc_feature (14)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
augaggaccuucuacaggutt

SEQ ID NO: 3860 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(3): 2'-deoxy-2'-fluoro
  misc_feature (4)..(8): 2'-deoxy
  misc_feature (9)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
caugaggaccuucuacaggtt

SEQ ID NO: 3861 - DNA, 21 bp, Artificial Sequence
  Description of Artificial Sequence:  synthetic
  misc_feature (1)..(1): 5'-3 attached terminal deoxyabasic moeity
  misc_feature (1)..(5): 2'-deoxy
  misc_feature (6)..(7): 2'-deoxy-2'-fluoro
  misc_feature (8)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
agaaaccagacguaagugutt

SEQ ID NO: 3862 - DNA, 21 bp, Artificial Sequence
  Description of Artificial Sequence:  synthetic
  misc_feature (1)..(8): 2'-deoxy
  misc_feature (1)..(1): 5'-3 attached terminal deoxyabasic moeity
  misc_feature (9)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
gaaagaaaccagacguaagtt

SEQ ID NO: 3863 - DNA, 21 bp, Artificial Sequence
  Description of Artificial Sequence:  synthetic
  misc_feature (1)..(1): 2'-O-methyl
  misc_feature (2)..(4): 2'-deoxy-2'-fluoro
  misc_feature (5)..(5): 2'-O-methyl
  misc_feature (6)..(6): 2'-deoxy-2'-fluoro
  misc_feature (7)..(12): 2'-O-methyl
  misc_feature (13)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
accuguagaagguccucautt

SEQ ID NO: 3864 - DNA, 21 bp, Artificial Sequence
  Description of Artificial Sequence:  synthetic
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (6)..(11): 2'-O-methyl
  misc_feature (12)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
ccuguagaagguccucaugtt

SEQ ID NO: 3865 - DNA, 21 bp, Artificial Sequence
  Description of Artificial Sequence:  synthetic
  misc_feature (1)..(1): 2'-O-methyl
  misc_feature (2)..(2): 2'-deoxy-2'-fluoro
  misc_feature (3)..(3): 2'-O-methyl
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(12): 2'-deoxy-2'-fluoro
  misc_feature (13)..(14): 2'-O-methyl
  misc_feature (15)..(19): 2'-deoxy-2'-fluoro
  misc_feature (20)..(20): Phosphorothioate 3'-Internucleotide Linkage
  misc_feature (1)..(19): ribonucleotide modified as described
acacuuacgucugguuucutt

SEQ ID NO: 3866 - DNA, 21 bp, Artificial Sequence
  Description of Artificial Sequence:  synthetic
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(11): 2'-O-methyl
  misc_feature (12)..(19): 2'-deoxy-2'-fluoro
  misc_feature (20)..(20): Phosphorothioate 3'-Internucleotide Linkage
  misc_feature (1)..(19): ribonucleotide modified as described
cuuacgucugguuucuuuctt

SEQ ID NO: 3867 - DNA, 21 bp, Artificial Sequence
  Description of Artificial Sequence:  synthetic
  misc_feature (1)..(19): ribonucleotide modified as described
accucaccaaggccagcactt

SEQ ID NO: 3868 - DNA, 21 bp, Artificial Sequence
  Description of Artificial Sequence:  synthetic
  misc_feature (1)..(19): ribonucleotide modified as described
gugcuggccuuggugaggutt

SEQ ID NO: 3869 - DNA, 21 bp, Artificial Sequence
  Description of Artificial Sequence:  synthetic
  misc_feature (1)..(1): 5'-3 attached terminal deoxyabasic moeity
  misc_feature (2)..(5): 2'-deoxy-2'-fluoro
  misc_feature (7)..(8): 2'-deoxy-2'-fluoro
  misc_feature (13)..(14): 2'-deoxy-2'-fluoro
  misc_feature (17)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
accucaccaaggccagcactt

SEQ ID NO: 3870 - DNA, 21 bp, Artificial Sequence
  Description of Artificial Sequence:  synthetic
  misc_feature (2)..(2): 2'-deoxy-2'-fluoro
  misc_feature (4)..(5): 2'-deoxy-2'-fluoro
  misc_feature (8)..(11): 2'-deoxy-2'-fluoro
  misc_feature (14)..(14): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide modified as described
gugcuggccuuggugaggutt

SEQ ID NO: 3871 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
accucaccaaggccagcactt

SEQ ID NO: 3872 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
gugcuggccuuggugaggutt

SEQ ID NO: 3873 - DNA, 21 bp, Artificial Sequence
  Description of Artificial Sequence:  synthetic
  misc_feature (1)..(19): ribonucleotide modified as described
cacgaccggaaccacuccatt

SEQ ID NO: 3874 - DNA, 21 bp, Artificial Sequence
  Description of Artificial Sequence:  synthetic
  misc_feature (1)..(19): ribonucleotide modified as described
uggagugguuccggucgugtt

SEQ ID NO: 3875 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (3)..(3): 2'-deoxy-2'-fluoro
  misc_feature (6)..(7): 2'-deoxy-2'-fluoro
  misc_feature (12)..(13): 2'-deoxy-2'-fluoro
  misc_feature (15)..(18): 2'-deoxy-2'-fluoro
  misc_feature (1)..(19): ribonucleotide modified as described
  misc_feature (21)..(21): 3'-3 attached terminal deoxyabasic moeity
cacgaccggaaccacuccatt

SEQ ID NO: 3876 - DNA, 21 bp, Artificial Sequence
  Description of Artificial Sequence:  synthetic
  misc_feature (1)..(1): 2'-deoxy-2'-fluoro
  misc_feature (2)..(5): 2'-O-methyl
  misc_feature (6)..(6): 2'-deoxy-2'-fluoro
  misc_feature (7)..(8): 2'-O-methyl
  misc_feature (9)..(12): 2'-deoxy-2'-fluoro
  misc_feature (13)..(14): 2'-O-methyl
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide modified as described
uggagugguuccggucgugtt

SEQ ID NO: 3877 - DNA, 21 bp, Artificial Sequence
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): 3'-3 attached terminal deoxyabasic moeity
cacgaccggaaccacuccatt

SEQ ID NO: 3878 - DNA, 21 bp, Artificial Sequence
  Description of Artificial Sequence:  synthetic
  misc_feature (20)..(20): Phosphorothioate 3'-Internucleotide Linkage
  misc_feature (1)..(19): ribonucleotide modified as described
uggagugguuccggucgugtt

SEQ ID NO: 3879 - DNA, 21 bp, Artificial Sequence
  Description of Artificial Sequence:  synthetic
  misc_feature (1)..(19): ribonucleotide modified as described
agagacggggucagagagatt

SEQ ID NO: 3880 - DNA, 21 bp, Artificial Sequence
  Description of Artificial Sequence:  synthetic
  misc_feature (1)..(19): ribonucleotide modified as described
agcauuuguuuguacaagatt

SEQ ID NO: 3881 - DNA, 21 bp, Artificial Sequence
  Description of Artificial Sequence:  synthetic
  misc_feature (1)..(19): ribonucleotide modified as described
ucucucugaccccgucucutt

SEQ ID NO: 3882 - DNA, 21 bp, Artificial Sequence
  Description of Artificial Sequence:  synthetic
  misc_feature (1)..(19): ribonucleotide modified as described
ucuuguacaaacaaaugcutt

SEQ ID NO: 3883 - DNA, 21 bp, Artificial Sequence
  Description of Artificial Sequence:  synthetic
  misc_feature (1)..(19): ribonucleotide modified as described
ccucuucuuuuuucuuaaatt

SEQ ID NO: 3884 - DNA, 21 bp, Artificial Sequence
  Description of Artificial Sequence:  synthetic
  misc_feature (1)..(19): ribonucleotide modified as described
cucuucuuuuuucuuaaactt

SEQ ID NO: 3885 - DNA, 21 bp, Artificial Sequence
  Description of Artificial Sequence:  synthetic
  misc_feature (1)..(19): ribonucleotide modified as described
ucuucuuuuuucuuaaacatt

SEQ ID NO: 3886 - DNA, 21 bp, Artificial Sequence
  Description of Artificial Sequence:  synthetic
  misc_feature (1)..(19): ribonucleotide modified as described
uucuuuuuucuuaaacauutt

SEQ ID NO: 3887 - DNA, 21 bp, Artificial Sequence
  Description of Artificial Sequence:  synthetic
  misc_feature (1)..(19): ribonucleotide modified as described
uuuuuucuuaaacauuuuutt

SEQ ID NO: 3888 - DNA, 21 bp, Artificial Sequence
  Description of Artificial Sequence:  synthetic
  misc_feature (1)..(19): ribonucleotide modified as described
uuuucuuaaacauuuuuuutt

SEQ ID NO: 3889 - DNA, 21 bp, Artificial Sequence
  Description of Artificial Sequence:  synthetic
  misc_feature (1)..(19): ribonucleotide modified as described
uuucuuaaacauuuuuuuutt

SEQ ID NO: 3890 - DNA, 21 bp, Artificial Sequence
  Description of Artificial Sequence:  synthetic
  misc_feature (1)..(19): ribonucleotide modified as described
cauuuuuuuuuaaaacugutt

SEQ ID NO: 3891 - DNA, 21 bp, Artificial Sequence
  Description of Artificial Sequence:  synthetic
  misc_feature (1)..(19): ribonucleotide modified as described
uuuuuaaaacuguauuguutt

SEQ ID NO: 3892 - DNA, 21 bp, Artificial Sequence
  Description of Artificial Sequence:  synthetic
  misc_feature (1)..(19): ribonucleotide modified as described
uuuuaaaacuguauuguuutt

SEQ ID NO: 3893 - DNA, 21 bp, Artificial Sequence
  Description of Artificial Sequence:  synthetic
  misc_feature (1)..(19): ribonucleotide modified as described
aaaacuguauuguuucucgtt

SEQ ID NO: 3894 - DNA, 21 bp, Artificial Sequence
  Description of Artificial Sequence:  synthetic
  misc_feature (1)..(19): ribonucleotide modified as described
uguuucucguuuuaauuuatt

SEQ ID NO: 3895 - DNA, 21 bp, Artificial Sequence
  Description of Artificial Sequence:  synthetic
  misc_feature (1)..(19): ribonucleotide modified as described
auuuuugcuugccauuccctt

SEQ ID NO: 3896 - DNA, 21 bp, Artificial Sequence
  Description of Artificial Sequence:  synthetic
  misc_feature (1)..(19): ribonucleotide modified as described
cccacuugaaucgggccgatt

SEQ ID NO: 3897 - DNA, 21 bp, Artificial Sequence
  Description of Artificial Sequence:  synthetic
  misc_feature (1)..(19): ribonucleotide modified as described
ccacuugaaucgggccgactt

SEQ ID NO: 3898 - DNA, 21 bp, Artificial Sequence
  Description of Artificial Sequence:  synthetic
  misc_feature (1)..(19): ribonucleotide modified as described
ccagagagaagucgaggaatt

SEQ ID NO: 3899 - DNA, 21 bp, Artificial Sequence
  Description of Artificial Sequence:  synthetic
  misc_feature (1)..(19): ribonucleotide modified as described
cagagagaagucgaggaagtt

SEQ ID NO: 3900 - DNA, 21 bp, Artificial Sequence
  Description of Artificial Sequence:  synthetic
  misc_feature (1)..(19): ribonucleotide modified as described
cagagagagcgcgcgggcgtt

SEQ ID NO: 3901 - DNA, 21 bp, Artificial Sequence
  Description of Artificial Sequence:  synthetic
  misc_feature (1)..(19): ribonucleotide modified as described
agcugaccagucgcgcugatt

SEQ ID NO: 3902 - DNA, 21 bp, Artificial Sequence
  Description of Artificial Sequence:  synthetic
  misc_feature (1)..(19): ribonucleotide modified as described
ccggagcccgcgcccggagtt

SEQ ID NO: 3903 - DNA, 21 bp, Artificial Sequence
  Description of Artificial Sequence:  synthetic
  misc_feature (1)..(19): ribonucleotide modified as described
cggagcccgcgcccggaggtt

SEQ ID NO: 3904 - DNA, 21 bp, Artificial Sequence
  Description of Artificial Sequence:  synthetic
  misc_feature (1)..(19): ribonucleotide modified as described
ggagcccgcgcccggaggctt

SEQ ID NO: 3905 - DNA, 21 bp, Artificial Sequence
  Description of Artificial Sequence:  synthetic
  misc_feature (1)..(19): ribonucleotide modified as described
cugaaacuuuucguccaactt

SEQ ID NO: 3906 - DNA, 21 bp, Artificial Sequence
  Description of Artificial Sequence:  synthetic
  misc_feature (1)..(19): ribonucleotide modified as described
ugaaacuuuucguccaacutt

SEQ ID NO: 3907 - DNA, 21 bp, Artificial Sequence
  Description of Artificial Sequence:  synthetic
  misc_feature (1)..(19): ribonucleotide modified as described
gaaacuuuucguccaacuutt

SEQ ID NO: 3908 - DNA, 21 bp, Artificial Sequence
  Description of Artificial Sequence:  synthetic
  misc_feature (1)..(19): ribonucleotide modified as described
cuuuucguccaacuucuggtt

SEQ ID NO: 3909 - DNA, 21 bp, Artificial Sequence
  Description of Artificial Sequence:  synthetic
  misc_feature (1)..(19): ribonucleotide modified as described
ucugggcuguucucgcuuctt

SEQ ID NO: 3910 - DNA, 21 bp, Artificial Sequence
  Description of Artificial Sequence:  synthetic
  misc_feature (1)..(19): ribonucleotide modified as described
ugggcuguucucgcuucggtt

SEQ ID NO: 3911 - DNA, 21 bp, Artificial Sequence
  Description of Artificial Sequence:  synthetic
  misc_feature (1)..(19): ribonucleotide modified as described
ggaggagccgugguccgcgtt

SEQ ID NO: 3912 - DNA, 21 bp, Artificial Sequence
  Description of Artificial Sequence:  synthetic
  misc_feature (1)..(19): ribonucleotide modified as described
gaggagccgugguccgcgctt

SEQ ID NO: 3913 - DNA, 21 bp, Artificial Sequence
  Description of Artificial Sequence:  synthetic
  misc_feature (1)..(19): ribonucleotide modified as described
gggaggagccgcagccggatt

SEQ ID NO: 3914 - DNA, 21 bp, Artificial Sequence
  Description of Artificial Sequence:  synthetic
  misc_feature (1)..(19): ribonucleotide modified as described
ggaggagccgcagccggagtt

SEQ ID NO: 3915 - DNA, 21 bp, Artificial Sequence
  Description of Artificial Sequence:  synthetic
  misc_feature (1)..(19): ribonucleotide modified as described
gaggagccgcagccggaggtt

SEQ ID NO: 3916 - DNA, 21 bp, Artificial Sequence
  Description of Artificial Sequence:  synthetic
  misc_feature (1)..(19): ribonucleotide modified as described
agagaaggaagaggagaggtt

SEQ ID NO: 3917 - DNA, 21 bp, Artificial Sequence
  Description of Artificial Sequence:  synthetic
  misc_feature (1)..(19): ribonucleotide modified as described
gcuccagccgcgcgcgcuctt

SEQ ID NO: 3918 - DNA, 21 bp, Artificial Sequence
  Description of Artificial Sequence:  synthetic
  misc_feature (1)..(19): ribonucleotide modified as described
cccacagcccgagccggagtt

SEQ ID NO: 3919 - DNA, 21 bp, Artificial Sequence
  Description of Artificial Sequence:  synthetic
  misc_feature (1)..(19): ribonucleotide modified as described
ccacagcccgagccggagatt

SEQ ID NO: 3920 - DNA, 21 bp, Artificial Sequence
  Description of Artificial Sequence:  synthetic
  misc_feature (1)..(19): ribonucleotide modified as described
caugaacuuucugcugucutt

SEQ ID NO: 3921 - DNA, 21 bp, Artificial Sequence
  Description of Artificial Sequence:  synthetic
  misc_feature (1)..(19): ribonucleotide modified as described
acuuucugcugucuugggutt

SEQ ID NO: 3922 - DNA, 21 bp, Artificial Sequence
  Description of Artificial Sequence:  synthetic
  misc_feature (1)..(19): ribonucleotide modified as described
ugcugucuugggugcauugtt

SEQ ID NO: 3923 - DNA, 21 bp, Artificial Sequence
  Description of Artificial Sequence:  synthetic
  misc_feature (1)..(19): ribonucleotide modified as described
ugcauuggagccuugccuutt

SEQ ID NO: 3924 - DNA, 21 bp, Artificial Sequence
  Description of Artificial Sequence:  synthetic
  misc_feature (1)..(19): ribonucleotide modified as described
cuugccuugcugcucuacctt

SEQ ID NO: 3925 - DNA, 21 bp, Artificial Sequence
  Description of Artificial Sequence:  synthetic
  misc_feature (1)..(19): ribonucleotide modified as described
accuccaccaugccaagugtt

SEQ ID NO: 3926 - DNA, 21 bp, Artificial Sequence
  Description of Artificial Sequence:  synthetic
  misc_feature (1)..(19): ribonucleotide modified as described
ccuccaccaugccaaguggtt

SEQ ID NO: 3927 - DNA, 21 bp, Artificial Sequence
  Description of Artificial Sequence:  synthetic
  misc_feature (1)..(19): ribonucleotide modified as described
ccaugccaaguggucccagtt

SEQ ID NO: 3928 - DNA, 21 bp, Artificial Sequence
  Description of Artificial Sequence:  synthetic
  misc_feature (1)..(19): ribonucleotide modified as described
ccaggcugcacccauggcatt

SEQ ID NO: 3929 - DNA, 21 bp, Artificial Sequence
  Description of Artificial Sequence:  synthetic
  misc_feature (1)..(19): ribonucleotide modified as described
ucuaucagcgcagcuacugtt

SEQ ID NO: 3930 - DNA, 21 bp, Artificial Sequence
  Description of Artificial Sequence:  synthetic
  misc_feature (1)..(19): ribonucleotide modified as described
ucuuccaggaguacccugatt

SEQ ID NO: 3931 - DNA, 21 bp, Artificial Sequence
  Description of Artificial Sequence:  synthetic
  misc_feature (1)..(19): ribonucleotide modified as described
ucuucaagccauccugugutt

SEQ ID NO: 3932 - DNA, 21 bp, Artificial Sequence
  Description of Artificial Sequence:  synthetic
  misc_feature (1)..(19): ribonucleotide modified as described
aaugacgagggccuggagutt

SEQ ID NO: 3933 - DNA, 21 bp, Artificial Sequence
  Description of Artificial Sequence:  synthetic
  misc_feature (1)..(19): ribonucleotide modified as described
ggccuggagugugugcccatt

SEQ ID NO: 3934 - DNA, 21 bp, Artificial Sequence
  Description of Artificial Sequence:  synthetic
  misc_feature (1)..(19): ribonucleotide modified as described
cacugaggaguccaacauctt

SEQ ID NO: 3935 - DNA, 21 bp, Artificial Sequence
  Description of Artificial Sequence:  synthetic
  misc_feature (1)..(19): ribonucleotide modified as described
caacaucaccaugcagauutt

SEQ ID NO: 3936 - DNA, 21 bp, Artificial Sequence
  Description of Artificial Sequence:  synthetic
  misc_feature (1)..(19): ribonucleotide modified as described
aucaccaugcagauuaugctt

SEQ ID NO: 3937 - DNA, 21 bp, Artificial Sequence
  Description of Artificial Sequence:  synthetic
  misc_feature (1)..(19): ribonucleotide modified as described
cagauuaugcggaucaaactt

SEQ ID NO: 3938 - DNA, 21 bp, Artificial Sequence
  Description of Artificial Sequence:  synthetic
  misc_feature (1)..(19): ribonucleotide modified as described
agauuaugcggaucaaacctt

SEQ ID NO: 3939 - DNA, 21 bp, Artificial Sequence
  Description of Artificial Sequence:  synthetic
  misc_feature (1)..(19): ribonucleotide modified as described
gauuaugcggaucaaaccutt

SEQ ID NO: 3940 - DNA, 21 bp, Artificial Sequence
  Description of Artificial Sequence:  synthetic
  misc_feature (1)..(19): ribonucleotide modified as described
aggagagaugagcuuccuatt

SEQ ID NO: 3941 - DNA, 21 bp, Artificial Sequence
  Description of Artificial Sequence:  synthetic
  misc_feature (1)..(19): ribonucleotide modified as described
gagcuuccuacagcacaactt

SEQ ID NO: 3942 - DNA, 21 bp, Artificial Sequence
  Description of Artificial Sequence:  synthetic
  misc_feature (1)..(19): ribonucleotide modified as described
cuuccuacagcacaacaaatt

SEQ ID NO: 3943 - DNA, 21 bp, Artificial Sequence
  Description of Artificial Sequence:  synthetic
  misc_feature (1)..(19): ribonucleotide modified as described
acagcacaacaaaugugaatt

SEQ ID NO: 3944 - DNA, 21 bp, Artificial Sequence
  Description of Artificial Sequence:  synthetic
  misc_feature (1)..(19): ribonucleotide modified as described
cagcacaacaaaugugaautt

SEQ ID NO: 3945 - DNA, 21 bp, Artificial Sequence
  Description of Artificial Sequence:  synthetic
  misc_feature (1)..(19): ribonucleotide modified as described
aaaugugaaugcagaccaatt

SEQ ID NO: 3946 - DNA, 21 bp, Artificial Sequence
  Description of Artificial Sequence:  synthetic
  misc_feature (1)..(19): ribonucleotide modified as described
uuuaagaaaaaagaagaggtt

SEQ ID NO: 3947 - DNA, 21 bp, Artificial Sequence
  Description of Artificial Sequence:  synthetic
  misc_feature (1)..(19): ribonucleotide modified as described
guuuaagaaaaaagaagagtt

SEQ ID NO: 3948 - DNA, 21 bp, Artificial Sequence
  Description of Artificial Sequence:  synthetic
  misc_feature (1)..(19): ribonucleotide modified as described
uguuuaagaaaaaagaagatt

SEQ ID NO: 3949 - DNA, 21 bp, Artificial Sequence
  Description of Artificial Sequence:  synthetic
  misc_feature (1)..(19): ribonucleotide modified as described
aauguuuaagaaaaaagaatt

SEQ ID NO: 3950 - DNA, 21 bp, Artificial Sequence
  Description of Artificial Sequence:  synthetic
  misc_feature (1)..(19): ribonucleotide modified as described
aaaaauguuuaagaaaaaatt

SEQ ID NO: 3951 - DNA, 21 bp, Artificial Sequence
  Description of Artificial Sequence:  synthetic
  misc_feature (1)..(19): ribonucleotide modified as described
aaaaaaauguuuaagaaaatt

SEQ ID NO: 3952 - DNA, 21 bp, Artificial Sequence
  Description of Artificial Sequence:  synthetic
  misc_feature (1)..(19): ribonucleotide modified as described
aaaaaaaauguuuaagaaatt

SEQ ID NO: 3953 - DNA, 21 bp, Artificial Sequence
  Description of Artificial Sequence:  synthetic
  misc_feature (1)..(19): ribonucleotide modified as described
acaguuuuaaaaaaaaaugtt

SEQ ID NO: 3954 - DNA, 21 bp, Artificial Sequence
  Description of Artificial Sequence:  synthetic
  misc_feature (1)..(19): ribonucleotide modified as described
aacaauacaguuuuaaaaatt

SEQ ID NO: 3955 - DNA, 21 bp, Artificial Sequence
  Description of Artificial Sequence:  synthetic
  misc_feature (1)..(19): ribonucleotide modified as described
aaacaauacaguuuuaaaatt

SEQ ID NO: 3956 - DNA, 21 bp, Artificial Sequence
  Description of Artificial Sequence:  synthetic
  misc_feature (1)..(19): ribonucleotide modified as described
cgagaaacaauacaguuuutt

SEQ ID NO: 3957 - DNA, 21 bp, Artificial Sequence
  Description of Artificial Sequence:  synthetic
  misc_feature (1)..(19): ribonucleotide modified as described
uaaauuaaaacgagaaacatt

SEQ ID NO: 3958 - DNA, 21 bp, Artificial Sequence
  Description of Artificial Sequence:  synthetic
  misc_feature (1)..(19): ribonucleotide modified as described
gggaauggcaagcaaaaautt

SEQ ID NO: 3959 - DNA, 21 bp, Artificial Sequence
  Description of Artificial Sequence:  synthetic
  misc_feature (1)..(19): ribonucleotide modified as described
ucggcccgauucaagugggtt

SEQ ID NO: 3960 - DNA, 21 bp, Artificial Sequence
  Description of Artificial Sequence:  synthetic
  misc_feature (1)..(19): ribonucleotide modified as described
gucggcccgauucaaguggtt

SEQ ID NO: 3961 - DNA, 21 bp, Artificial Sequence
  Description of Artificial Sequence:  synthetic
  misc_feature (1)..(19): ribonucleotide modified as described
uuccucgacuucucucuggtt

SEQ ID NO: 3962 - DNA, 21 bp, Artificial Sequence
  Description of Artificial Sequence:  synthetic
  misc_feature (1)..(19): ribonucleotide modified as described
cuuccucgacuucucucugtt

SEQ ID NO: 3963 - DNA, 21 bp, Artificial Sequence
  Description of Artificial Sequence:  synthetic
  misc_feature (1)..(19): ribonucleotide modified as described
cgcccgcgcgcucucucugtt

SEQ ID NO: 3964 - DNA, 21 bp, Artificial Sequence
  Description of Artificial Sequence:  synthetic
  misc_feature (1)..(19): ribonucleotide modified as described
ucagcgcgacuggucagcutt

SEQ ID NO: 3965 - DNA, 21 bp, Artificial Sequence
  Description of Artificial Sequence:  synthetic
  misc_feature (1)..(19): ribonucleotide modified as described
cuccgggcgcgggcuccggtt

SEQ ID NO: 3966 - DNA, 21 bp, Artificial Sequence
  Description of Artificial Sequence:  synthetic
  misc_feature (1)..(19): ribonucleotide modified as described
ccuccgggcgcgggcuccgtt

SEQ ID NO: 3967 - DNA, 21 bp, Artificial Sequence
  Description of Artificial Sequence:  synthetic
  misc_feature (1)..(19): ribonucleotide modified as described
gccuccgggcgcgggcucctt

SEQ ID NO: 3968 - DNA, 21 bp, Artificial Sequence
  Description of Artificial Sequence:  synthetic
  misc_feature (1)..(19): ribonucleotide modified as described
guuggacgaaaaguuucagtt

SEQ ID NO: 3969 - DNA, 21 bp, Artificial Sequence
  Description of Artificial Sequence:  synthetic
  misc_feature (1)..(19): ribonucleotide modified as described
aguuggacgaaaaguuucatt

SEQ ID NO: 3970 - DNA, 21 bp, Artificial Sequence
  Description of Artificial Sequence:  synthetic
  misc_feature (1)..(19): ribonucleotide modified as described
aaguuggacgaaaaguuuctt

SEQ ID NO: 3971 - DNA, 21 bp, Artificial Sequence
  Description of Artificial Sequence:  synthetic
  misc_feature (1)..(19): ribonucleotide modified as described
ccagaaguuggacgaaaagtt

SEQ ID NO: 3972 - DNA, 21 bp, Artificial Sequence
  Description of Artificial Sequence:  synthetic
  misc_feature (1)..(19): ribonucleotide modified as described
gaagcgagaacagcccagatt

SEQ ID NO: 3973 - DNA, 21 bp, Artificial Sequence
  Description of Artificial Sequence:  synthetic
  misc_feature (1)..(19): ribonucleotide modified as described
ccgaagcgagaacagcccatt

SEQ ID NO: 3974 - DNA, 21 bp, Artificial Sequence
  Description of Artificial Sequence:  synthetic
  misc_feature (1)..(19): ribonucleotide modified as described
cgcggaccacggcuccucctt

SEQ ID NO: 3975 - DNA, 21 bp, Artificial Sequence
  Description of Artificial Sequence:  synthetic
  misc_feature (1)..(19): ribonucleotide modified as described
gcgcggaccacggcuccuctt

SEQ ID NO: 3976 - DNA, 21 bp, Artificial Sequence
  Description of Artificial Sequence:  synthetic
  misc_feature (1)..(19): ribonucleotide modified as described
uccggcugcggcuccuccctt

SEQ ID NO: 3977 - DNA, 21 bp, Artificial Sequence
  Description of Artificial Sequence:  synthetic
  misc_feature (1)..(19): ribonucleotide modified as described
cuccggcugcggcuccucctt

SEQ ID NO: 3978 - DNA, 21 bp, Artificial Sequence
  Description of Artificial Sequence:  synthetic
  misc_feature (1)..(19): ribonucleotide modified as described
ccuccggcugcggcuccuctt

SEQ ID NO: 3979 - DNA, 21 bp, Artificial Sequence
  Description of Artificial Sequence:  synthetic
  misc_feature (1)..(19): ribonucleotide modified as described
ccucuccucuuccuucucutt

SEQ ID NO: 3980 - DNA, 21 bp, Artificial Sequence
  Description of Artificial Sequence:  synthetic
  misc_feature (1)..(19): ribonucleotide modified as described
gagcgcgcgcggcuggagctt

SEQ ID NO: 3981 - DNA, 21 bp, Artificial Sequence
  Description of Artificial Sequence:  synthetic
  misc_feature (1)..(19): ribonucleotide modified as described
cuccggcucgggcugugggtt

SEQ ID NO: 3982 - DNA, 21 bp, Artificial Sequence
  Description of Artificial Sequence:  synthetic
  misc_feature (1)..(19): ribonucleotide modified as described
ucuccggcucgggcuguggtt

SEQ ID NO: 3983 - DNA, 21 bp, Artificial Sequence
  Description of Artificial Sequence:  synthetic
  misc_feature (1)..(19): ribonucleotide modified as described
agacagcagaaaguucaugtt

SEQ ID NO: 3984 - DNA, 21 bp, Artificial Sequence
  Description of Artificial Sequence:  synthetic
  misc_feature (1)..(19): ribonucleotide modified as described
acccaagacagcagaaagutt

SEQ ID NO: 3985 - DNA, 21 bp, Artificial Sequence
  Description of Artificial Sequence:  synthetic
  misc_feature (1)..(19): ribonucleotide modified as described
caaugcacccaagacagcatt

SEQ ID NO: 3986 - DNA, 21 bp, Artificial Sequence
  Description of Artificial Sequence:  synthetic
  misc_feature (1)..(19): ribonucleotide modified as described
aaggcaaggcuccaaugcatt

SEQ ID NO: 3987 - DNA, 21 bp, Artificial Sequence
  Description of Artificial Sequence:  synthetic
  misc_feature (1)..(19): ribonucleotide modified as described
gguagagcagcaaggcaagtt

SEQ ID NO: 3988 - DNA, 21 bp, Artificial Sequence
  Description of Artificial Sequence:  synthetic
  misc_feature (1)..(19): ribonucleotide modified as described
cacuuggcaugguggaggutt

SEQ ID NO: 3989 - DNA, 21 bp, Artificial Sequence
  Description of Artificial Sequence:  synthetic
  misc_feature (1)..(19): ribonucleotide modified as described
ccacuuggcaugguggaggtt

SEQ ID NO: 3990 - DNA, 21 bp, Artificial Sequence
  Description of Artificial Sequence:  synthetic
  misc_feature (1)..(19): ribonucleotide modified as described
cugggaccacuuggcauggtt

SEQ ID NO: 3991 - DNA, 21 bp, Artificial Sequence
  Description of Artificial Sequence:  synthetic
  misc_feature (1)..(19): ribonucleotide modified as described
ugccaugggugcagccuggtt

SEQ ID NO: 3992 - DNA, 21 bp, Artificial Sequence
  Description of Artificial Sequence:  synthetic
  misc_feature (1)..(19): ribonucleotide modified as described
caguagcugcgcugauagatt

SEQ ID NO: 3993 - DNA, 21 bp, Artificial Sequence
  Description of Artificial Sequence:  synthetic
  misc_feature (1)..(19): ribonucleotide modified as described
ucaggguacuccuggaagatt

SEQ ID NO: 3994 - DNA, 21 bp, Artificial Sequence
  Description of Artificial Sequence:  synthetic
  misc_feature (1)..(19): ribonucleotide modified as described
acacaggauggcuugaagatt

SEQ ID NO: 3995 - DNA, 21 bp, Artificial Sequence
  Description of Artificial Sequence:  synthetic
  misc_feature (1)..(19): ribonucleotide modified as described
acuccaggcccucgucauutt

SEQ ID NO: 3996 - DNA, 21 bp, Artificial Sequence
  Description of Artificial Sequence:  synthetic
  misc_feature (1)..(19): ribonucleotide modified as described
ugggcacacacuccaggcctt

SEQ ID NO: 3997 - DNA, 21 bp, Artificial Sequence
  Description of Artificial Sequence:  synthetic
  misc_feature (1)..(19): ribonucleotide modified as described
gauguuggacuccucagugtt

SEQ ID NO: 3998 - DNA, 21 bp, Artificial Sequence
  Description of Artificial Sequence:  synthetic
  misc_feature (1)..(19): ribonucleotide modified as described
aaucugcauggugauguugtt

SEQ ID NO: 3999 - DNA, 21 bp, Artificial Sequence
  Description of Artificial Sequence:  synthetic
  misc_feature (1)..(19): ribonucleotide modified as described
gcauaaucugcauggugautt

SEQ ID NO: 4000 - DNA, 21 bp, Artificial Sequence
  Description of Artificial Sequence:  synthetic
  misc_feature (1)..(19): ribonucleotide modified as described
guuugauccgcauaaucugtt

SEQ ID NO: 4001 - DNA, 21 bp, Artificial Sequence
  Description of Artificial Sequence:  synthetic
  misc_feature (1)..(19): ribonucleotide modified as described
gguuugauccgcauaaucutt

SEQ ID NO: 4002 - DNA, 21 bp, Artificial Sequence
  Description of Artificial Sequence:  synthetic
  misc_feature (1)..(19): ribonucleotide modified as described
agguuugauccgcauaauctt

SEQ ID NO: 4003 - DNA, 21 bp, Artificial Sequence
  Description of Artificial Sequence:  synthetic
  misc_feature (1)..(19): ribonucleotide modified as described
uaggaagcucaucucuccutt

SEQ ID NO: 4004 - DNA, 21 bp, Artificial Sequence
  Description of Artificial Sequence:  synthetic
  misc_feature (1)..(19): ribonucleotide modified as described
guugugcuguaggaagcuctt

SEQ ID NO: 4005 - DNA, 21 bp, Artificial Sequence
  Description of Artificial Sequence:  synthetic
  misc_feature (1)..(19): ribonucleotide modified as described
uuuguugugcuguaggaagtt

SEQ ID NO: 4006 - DNA, 21 bp, Artificial Sequence
  Description of Artificial Sequence:  synthetic
  misc_feature (1)..(19): ribonucleotide modified as described
uucacauuuguugugcugutt

SEQ ID NO: 4007 - DNA, 21 bp, Artificial Sequence
  Description of Artificial Sequence:  synthetic
  misc_feature (1)..(19): ribonucleotide modified as described
auucacauuuguugugcugtt

SEQ ID NO: 4008 - DNA, 21 bp, Artificial Sequence
  Description of Artificial Sequence:  synthetic
  misc_feature (1)..(19): ribonucleotide modified as described
uuggucugcauucacauuutt

SEQ ID NO: 4009 - DNA, 21 bp, Artificial Sequence
  Description of Artificial Sequence:  synthetic
  misc_feature (1)..(1): 5'-3 attached terminal deoxyabasic moeity
  misc_feature (1)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(13): 2'-deoxy-2'-fluoro
  misc_feature (14)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ccuccaccaugccaaguggtt

SEQ ID NO: 4010 - DNA, 21 bp, Artificial Sequence
  Description of Artificial Sequence:  synthetic
  misc_feature (1)..(4): 2'-deoxy-2'-fluoro
  misc_feature (1)..(1): 5'-3 attached terminal deoxyabasic moeity
  misc_feature (5)..(5): 2'-deoxy
  misc_feature (6)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(12): 2'-deoxy-2'-fluoro
  misc_feature (13)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
cuccaccaugccaaguggutt

SEQ ID NO: 4011 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(10): 2'-deoxy
  misc_feature (11)..(11): 2'-deoxy-2'-fluoro
  misc_feature (12)..(13): 2'-deoxy
  misc_feature (14)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ccaugccaaguggucccagtt

SEQ ID NO: 4012 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (7)..(9): 2'-deoxy
  misc_feature (10)..(10): 2'-deoxy-2'-fluoro
  misc_feature (11)..(12): 2'-deoxy
  misc_feature (13)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
caugccaaguggucccaggtt

SEQ ID NO: 4013 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(8): 2'-deoxy
  misc_feature (9)..(9): 2'-deoxy-2'-fluoro
  misc_feature (10)..(11): 2'-deoxy
  misc_feature (12)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
augccaaguggucccaggctt

SEQ ID NO: 4014 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(4): 2'-deoxy-2'-fluoro
  misc_feature (5)..(7): 2'-deoxy
  misc_feature (8)..(8): 2'-deoxy-2'-fluoro
  misc_feature (9)..(10): 2'-deoxy
  misc_feature (11)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
ugccaaguggucccaggcutt

SEQ ID NO: 4015 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(13): 2'-deoxy-2'-fluoro
  misc_feature (14)..(16): 2'-deoxy
  misc_feature (17)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
gccaaguggucccaggcugtt

SEQ ID NO: 4016 - DNA, 21 bp, Artificial Sequence
  Description of Artificial Sequence:  synthetic
  misc_feature (1)..(2): 2'-deoxy-2'-fluoro
  misc_feature (1)..(1): 5'-3 attached terminal deoxyabasic moeity
  misc_feature (3)..(5): 2'-deoxy
  misc_feature (6)..(6): 2'-deoxy-2'-fluoro
  misc_feature (7)..(8): 2'-deoxy
  misc_feature (9)..(12): 2'-deoxy-2'-fluoro
  misc_feature (13)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
ccaaguggucccaggcugctt

SEQ ID NO: 4017 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(4): 2'-deoxy
  misc_feature (5)..(8): 2'-deoxy-2'-fluoro
  misc_feature (9)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (1)..(19): ribonucleotide modified as described
  misc_feature (21)..(21): 3'-3 attached terminal deoxyabasic moeity
guggucccaggcugcaccctt

SEQ ID NO: 4018 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(3): 2'-deoxy
  misc_feature (4)..(7): 2'-deoxy-2'-fluoro
  misc_feature (8)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
uggucccaggcugcacccatt

SEQ ID NO: 4019 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy-2'-fluoro
  misc_feature (5)..(6): 2'-deoxy
  misc_feature (7)..(7): 2'-deoxy-2'-fluoro
  misc_feature (8)..(10): 2'-deoxy
  misc_feature (11)..(11): 2'-deoxy-2'-fluoro
  misc_feature (12)..(12): 2'-deoxy
  misc_feature (13)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
cccugguggacaucuuccatt

SEQ ID NO: 4020 - DNA, 21 bp, Artificial Sequence
  Description of Artificial Sequence:  synthetic
  misc_feature (1)..(2): 2'-deoxy
  misc_feature (1)..(1): 5'-3 attached terminal deoxyabasic moeity
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(8): 2'-deoxy
  misc_feature (9)..(10): 2'-deoxy-2'-fluoro
  misc_feature (11)..(19): 2'-deoxy
  misc_feature (1)..(19): ribonucleotide modified as described
  misc_feature (21)..(21): 3'-3 attached terminal deoxyabasic moeity
aaugcagaccaaagaaagatt

SEQ ID NO: 4021 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
ucagagcggagaaagcauutt

SEQ ID NO: 4022 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (1)..(19): ribonucleotide modified as described
  misc_feature (21)..(21): 3'-3 attached terminal deoxyabasic moeity
gcagacguguaaauguucctt

SEQ ID NO: 4023 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(12): 2'-deoxy
  misc_feature (13)..(13): 2'-deoxy-2'-fluoro
  misc_feature (14)..(14): 2'-deoxy
  misc_feature (15)..(19): 2'-deoxy-2'-fluoro
  misc_feature (1)..(19): ribonucleotide modified as described
  misc_feature (21)..(21): 3'-3 attached terminal deoxyabasic moeity
cagacguguaaauguuccutt

SEQ ID NO: 4024 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
cguguaaauguuccugcaatt

SEQ ID NO: 4025 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (1)..(19): ribonucleotide modified as described
  misc_feature (21)..(21): 3'-3 attached terminal deoxyabasic moeity
uguaaauguuccugcaaaatt

SEQ ID NO: 4026 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(12): 2'-deoxy-2'-fluoro
  misc_feature (13)..(13): 2'-deoxy
  misc_feature (14)..(14): 2'-deoxy-2'-fluoro
  misc_feature (15)..(19): 2'-deoxy
  misc_feature (1)..(19): ribonucleotide modified as described
  misc_feature (21)..(21): 3'-3 attached terminal deoxyabasic moeity
guaaauguuccugcaaaaatt

SEQ ID NO: 4027 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(11): 2'-deoxy-2'-fluoro
  misc_feature (12)..(12): 2'-deoxy
  misc_feature (13)..(13): 2'-deoxy-2'-fluoro
  misc_feature (14)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
uaaauguuccugcaaaaactt

SEQ ID NO: 4028 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(5): 2'-deoxy
  misc_feature (6)..(10): 2'-deoxy-2'-fluoro
  misc_feature (11)..(11): 2'-deoxy
  misc_feature (12)..(12): 2'-deoxy-2'-fluoro
  misc_feature (13)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aaauguuccugcaaaaacatt

SEQ ID NO: 4029 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(3): 2'-deoxy-2'-fluoro
  misc_feature (4)..(4): 2'-deoxy
  misc_feature (5)..(9): 2'-deoxy-2'-fluoro
  misc_feature (10)..(10): 2'-deoxy
  misc_feature (11)..(11): 2'-deoxy-2'-fluoro
  misc_feature (12)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aauguuccugcaaaaacactt

SEQ ID NO: 4030 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(7): 2'-deoxy-2'-fluoro
  misc_feature (8)..(8): 2'-deoxy
  misc_feature (9)..(9): 2'-deoxy-2'-fluoro
  misc_feature (10)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
uguuccugcaaaaacacagtt

SEQ ID NO: 4031 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(6): 2'-deoxy-2'-fluoro
  misc_feature (7)..(7): 2'-deoxy
  misc_feature (8)..(8): 2'-deoxy-2'-fluoro
  misc_feature (9)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
guuccugcaaaaacacagatt

SEQ ID NO: 4032 - DNA, 21 bp, Artificial Sequence
  Description of Artificial Sequence:  synthetic
  misc_feature (1)..(5): 2'-deoxy-2'-fluoro
  misc_feature (1)..(1): 5'-3 attached terminal deoxyabasic moeity
  misc_feature (6)..(6): 2'-deoxy
  misc_feature (7)..(7): 2'-deoxy-2'-fluoro
  misc_feature (8)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
uuccugcaaaaacacagactt

SEQ ID NO: 4033 - DNA, 21 bp, Artificial Sequence
  Description of Artificial Sequence:  synthetic
  misc_feature (1)..(1): 5'-3 attached terminal deoxyabasic moeity
  misc_feature (1)..(4): 2'-deoxy-2'-fluoro
  misc_feature (5)..(5): 2'-deoxy
  misc_feature (6)..(6): 2'-deoxy-2'-fluoro
  misc_feature (7)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
uccugcaaaaacacagacutt

SEQ ID NO: 4034 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(13): 2'-deoxy
  misc_feature (14)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
gcaaaaacacagacucgcgtt

SEQ ID NO: 4035 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy-2'-fluoro
  misc_feature (2)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
caaaaacacagacucgcgutt

SEQ ID NO: 4036 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(9): 2'-deoxy
  misc_feature (10)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aaacacagacucgcguugctt

SEQ ID NO: 4037 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (1)..(19): ribonucleotide modified as described
  misc_feature (21)..(21): 3'-3 attached terminal deoxyabasic moeity
acagacucgcguugcaaggtt

SEQ ID NO: 4038 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(4): 2'-deoxy-2'-fluoro
  misc_feature (5)..(5): 2'-deoxy
  misc_feature (6)..(6): 2'-deoxy-2'-fluoro
  misc_feature (7)..(7): 2'-deoxy
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
acucgcguugcaaggcgagtt

SEQ ID NO: 4039 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(10): 2'-deoxy-2'-fluoro
  misc_feature (11)..(14): 2'-deoxy
  misc_feature (15)..(15): 2'-deoxy-2'-fluoro
  misc_feature (16)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
guugcaaggcgaggcagcutt

SEQ ID NO: 4040 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(5): 2'-deoxy
  misc_feature (6)..(6): 2'-deoxy-2'-fluoro
  misc_feature (7)..(10): 2'-deoxy
  misc_feature (11)..(11): 2'-deoxy-2'-fluoro
  misc_feature (12)..(13): 2'-deoxy
  misc_feature (14)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
caaggcgaggcagcuugagtt

SEQ ID NO: 4041 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy
  misc_feature (4)..(4): 2'-deoxy-2'-fluoro
  misc_feature (5)..(8): 2'-deoxy
  misc_feature (9)..(9): 2'-deoxy-2'-fluoro
  misc_feature (10)..(11): 2'-deoxy
  misc_feature (12)..(14): 2'-deoxy-2'-fluoro
  misc_feature (15)..(17): 2'-deoxy
  misc_feature (18)..(19): 2'-deoxy-2'-fluoro
  misc_feature (1)..(19): ribonucleotide modified as described
  misc_feature (21)..(21): 3'-3 attached terminal deoxyabasic moeity
aggcgaggcagcuugaguutt

SEQ ID NO: 4042 - DNA, 21 bp, Artificial Sequence
  Description of Artificial Sequence:  synthetic
  misc_feature (1)..(3): 2'-deoxy
  misc_feature (1)..(1): 5'-3 attached terminal deoxyabasic moeity
  misc_feature (4)..(4): 2'-deoxy-2'-fluoro
  misc_feature (5)..(6): 2'-deoxy
  misc_feature (7)..(9): 2'-deoxy-2'-fluoro
  misc_feature (10)..(12): 2'-deoxy
  misc_feature (13)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aggcagcuugaguuaaacgtt

SEQ ID NO: 4043 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(3): 2'-deoxy-2'-fluoro
  misc_feature (4)..(5): 2'-deoxy
  misc_feature (6)..(8): 2'-deoxy-2'-fluoro
  misc_feature (9)..(11): 2'-deoxy
  misc_feature (12)..(13): 2'-deoxy-2'-fluoro
  misc_feature (14)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
ggcagcuugaguuaaacgatt

SEQ ID NO: 4044 - DNA, 21 bp, Artificial Sequence
  Description of Artificial Sequence:  synthetic
  misc_feature (1)..(1): 2'-deoxy
  misc_feature (1)..(1): 5'-3 attached terminal deoxyabasic moeity
  misc_feature (2)..(2): 2'-deoxy-2'-fluoro
  misc_feature (3)..(4): 2'-deoxy
  misc_feature (5)..(7): 2'-deoxy-2'-fluoro
  misc_feature (8)..(10): 2'-deoxy
  misc_feature (11)..(12): 2'-deoxy-2'-fluoro
  misc_feature (13)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
gcagcuugaguuaaacgaatt

SEQ ID NO: 4045 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy
  misc_feature (3)..(5): 2'-deoxy-2'-fluoro
  misc_feature (6)..(8): 2'-deoxy
  misc_feature (9)..(10): 2'-deoxy-2'-fluoro
  misc_feature (11)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
agcuugaguuaaacgaacgtt

SEQ ID NO: 4046 - DNA, 21 bp, Artificial Sequence
  Description of Artificial Sequence:  synthetic
  misc_feature (1)..(2): 2'-deoxy
  misc_feature (1)..(1): 5'-3 attached terminal deoxyabasic moeity
  misc_feature (3)..(4): 2'-deoxy-2'-fluoro
  misc_feature (5)..(7): 2'-deoxy
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
aguuaaacgaacguacuugtt

SEQ ID NO: 4047 - DNA, 21 bp, Artificial Sequence
  Description of Artificial Sequence:  synthetic
  misc_feature (1)..(1): 5'-3 attached terminal deoxyabasic moeity
  misc_feature (1)..(2): 2'-deoxy-2'-fluoro
  misc_feature (3)..(5): 2'-deoxy
  misc_feature (6)..(6): 2'-deoxy-2'-fluoro
  misc_feature (7)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): 3'-3 attached terminal deoxyabasic moeity
uuaaacgaacguacuugcatt

SEQ ID NO: 4048 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
uaaacgaacguacuugcagtt

SEQ ID NO: 4049 - DNA, 21 bp, Artificial Sequence
  Description of Artificial Sequence:  synthetic
  misc_feature (1)..(1): 5'-3 attached terminal deoxyabasic moeity
  misc_feature (1)..(3): 2'-deoxy
  misc_feature (4)..(4): 2'-deoxy-2'-fluoro
  misc_feature (5)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
aaacgaacguacuugcagatt

SEQ ID NO: 4050 - DNA, 21 bp, Artificial Sequence
  Description of Artificial Sequence:  synthetic
  misc_feature (1)..(2): 2'-deoxy
  misc_feature (1)..(1): 5'-3 attached terminal deoxyabasic moeity
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
aacgaacguacuugcagautt

SEQ ID NO: 4051 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(6): 2'-deoxy-2'-fluoro
  misc_feature (7)..(7): 2'-deoxy
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (1)..(19): ribonucleotide modified as described
  misc_feature (21)..(21): 3'-3 attached terminal deoxyabasic moeity
guacuugcagaugugacaatt

SEQ ID NO: 4052 - DNA, 21 bp, Artificial Sequence
  Description of Artificial Sequence:  synthetic
  misc_feature (1)..(1): 2'-deoxy-2'-fluoro
  misc_feature (1)..(1): 5'-3 attached terminal deoxyabasic moeity
  misc_feature (2)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(19): 2'-deoxy
  misc_feature (1)..(19): ribonucleotide modified as described
  misc_feature (21)..(21): 3'-3 attached terminal deoxyabasic moeity
uacuugcagaugugacaagtt

SEQ ID NO: 4053 - DNA, 21 bp, Artificial Sequence
  Description of Artificial Sequence:  synthetic
  misc_feature (1)..(1): 5'-3 attached terminal deoxyabasic moeity
  misc_feature (1)..(1): 2'-deoxy
  misc_feature (2)..(4): 2'-deoxy-2'-fluoro
  misc_feature (5)..(5): 2'-deoxy
  misc_feature (6)..(6): 2'-deoxy-2'-fluoro
  misc_feature (7)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (1)..(19): ribonucleotide modified as described
  misc_feature (21)..(21): 3'-3 attached terminal deoxyabasic moeity
acuugcagaugugacaagctt

SEQ ID NO: 4054 - DNA, 21 bp, Artificial Sequence
  Description of Artificial Sequence:  synthetic
  misc_feature (4)..(6): 2'-deoxy-2'-fluoro
  misc_feature (7)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(19): 2'-O-methyl
  misc_feature (1)..(19): ribonucleotide modified as described
ccacuuggcaugguggaggtt

SEQ ID NO: 4055 - DNA, 21 bp, Artificial Sequence
  Description of Artificial Sequence:  synthetic
  misc_feature (4)..(4): 2'-O-methyl
  misc_feature (5)..(7): 2'-deoxy-2'-fluoro
  misc_feature (8)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-O-methyl
  misc_feature (15)..(15): 2'-deoxy-2'-fluoro
  misc_feature (16)..(19): 2'-O-methyl
  misc_feature (1)..(19): ribonucleotide modified as described
accacuuggcaugguggagtt

SEQ ID NO: 4056 - DNA, 21 bp, Artificial Sequence
  Description of Artificial Sequence:  synthetic
  misc_feature (4)..(6): 2'-O-methyl
  misc_feature (7)..(8): 2'-deoxy-2'-fluoro
  misc_feature (9)..(9): 2'-O-methyl
  misc_feature (10)..(12): 2'-deoxy-2'-fluoro
  misc_feature (13)..(14): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (1)..(19): ribonucleotide modified as described
cugggaccacuuggcauggtt

SEQ ID NO: 4057 - DNA, 21 bp, Artificial Sequence
  Description of Artificial Sequence:  synthetic
  misc_feature (4)..(7): 2'-O-methyl
  misc_feature (8)..(9): 2'-deoxy-2'-fluoro
  misc_feature (10)..(10): 2'-O-methyl
  misc_feature (11)..(13): 2'-deoxy-2'-fluoro
  misc_feature (14)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
ccugggaccacuuggcaugtt

SEQ ID NO: 4058 - DNA, 21 bp, Artificial Sequence
  Description of Artificial Sequence:  synthetic
  misc_feature (4)..(4): 2'-deoxy-2'-fluoro
  misc_feature (5)..(8): 2'-O-methyl
  misc_feature (9)..(10): 2'-deoxy-2'-fluoro
  misc_feature (11)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
gccugggaccacuuggcautt

SEQ ID NO: 4059 - DNA, 21 bp, Artificial Sequence
  Description of Artificial Sequence:  synthetic
  misc_feature (4)..(5): 2'-deoxy-2'-fluoro
  misc_feature (6)..(9): 2'-O-methyl
  misc_feature (10)..(11): 2'-deoxy-2'-fluoro
  misc_feature (12)..(12): 2'-O-methyl
  misc_feature (13)..(15): 2'-deoxy-2'-fluoro
  misc_feature (16)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
agccugggaccacuuggcatt

SEQ ID NO: 4060 - DNA, 21 bp, Artificial Sequence
  Description of Artificial Sequence:  synthetic
  misc_feature (4)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
cagccugggaccacuuggctt

SEQ ID NO: 4061 - DNA, 21 bp, Artificial Sequence
  Description of Artificial Sequence:  synthetic
  misc_feature (4)..(4): 2'-O-methyl
  misc_feature (5)..(7): 2'-deoxy-2'-fluoro
  misc_feature (8)..(11): 2'-O-methyl
  misc_feature (12)..(13): 2'-deoxy-2'-fluoro
  misc_feature (14)..(14): 2'-O-methyl
  misc_feature (15)..(17): 2'-deoxy-2'-fluoro
  misc_feature (18)..(19): 2'-O-methyl
  misc_feature (1)..(19): ribonucleotide modified as described
gcagccugggaccacuuggtt

SEQ ID NO: 4062 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
gggugcagccugggaccactt

SEQ ID NO: 4063 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(12): 2'-deoxy-2'-fluoro
  misc_feature (13)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
ugggugcagccugggaccatt

SEQ ID NO: 4064 - DNA, 21 bp, Artificial Sequence
  Description of Artificial Sequence:  synthetic
  misc_feature (4)..(7): 2'-O-methyl
  misc_feature (8)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (14)..(15): 2'-deoxy-2'-fluoro
  misc_feature (16)..(19): 2'-O-methyl
  misc_feature (1)..(19): ribonucleotide modified as described
uggaagauguccaccagggtt

SEQ ID NO: 4065 - DNA, 21 bp, Artificial Sequence
  Description of Artificial Sequence:  synthetic
  misc_feature (4)..(7): 2'-deoxy-2'-fluoro
  misc_feature (8)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
uacuccuggaagauguccatt

SEQ ID NO: 4066 - DNA, 21 bp, Artificial Sequence
  Description of Artificial Sequence:  synthetic
  misc_feature (4)..(6): 2'-deoxy-2'-fluoro
  misc_feature (7)..(8): 2'-O-methyl
  misc_feature (9)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
uucuuuggucugcauucactt

SEQ ID NO: 4067 - DNA, 21 bp, Artificial Sequence
  Description of Artificial Sequence:  synthetic
  misc_feature (4)..(8): 2'-deoxy-2'-fluoro
  misc_feature (9)..(10): 2'-O-methyl
  misc_feature (11)..(13): 2'-deoxy-2'-fluoro
  misc_feature (14)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
cuuucuuuggucugcauuctt

SEQ ID NO: 4068 - DNA, 21 bp, Artificial Sequence
  Description of Artificial Sequence:  synthetic
  misc_feature (4)..(9): 2'-deoxy-2'-fluoro
  misc_feature (10)..(11): 2'-O-methyl
  misc_feature (12)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
ucuuucuuuggucugcauutt

SEQ ID NO: 4069 - DNA, 21 bp, Artificial Sequence
  Description of Artificial Sequence:  synthetic
  misc_feature (4)..(4): 2'-O-methyl
  misc_feature (5)..(12): 2'-deoxy-2'-fluoro
  misc_feature (13)..(13): 2'-O-methyl
  misc_feature (14)..(17): 2'-deoxy-2'-fluoro
  misc_feature (18)..(19): 2'-O-methyl
  misc_feature (1)..(19): ribonucleotide modified as described
aaugcuuucuccgcucugatt

SEQ ID NO: 4070 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
ggaacauuuacacgucugctt

SEQ ID NO: 4071 - DNA, 21 bp, Artificial Sequence
  Description of Artificial Sequence:  synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
aggaacauuuacacgucugtt

SEQ ID NO: 4072 - DNA, 21 bp, Artificial Sequence
  Description of Artificial Sequence:  synthetic
  misc_feature (4)..(4): 2'-deoxy-2'-fluoro
  misc_feature (5)..(9): 2'-O-methyl
  misc_feature (10)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uugcaggaacauuuacacgtt

SEQ ID NO: 4073 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
uuuugcaggaacauuuacatt

SEQ ID NO: 4074 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
uuuuugcaggaacauuuactt

SEQ ID NO: 4075 - DNA, 21 bp, Artificial Sequence
  Description of Artificial Sequence:  synthetic
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
guuuuugcaggaacauuuatt

SEQ ID NO: 4076 - DNA, 21 bp, Artificial Sequence
  Description of Artificial Sequence:  synthetic
  misc_feature (4)..(7): 2'-deoxy-2'-fluoro
  misc_feature (8)..(8): 2'-O-methyl
  misc_feature (9)..(9): 2'-deoxy-2'-fluoro
  misc_feature (10)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
uguuuuugcaggaacauuutt

SEQ ID NO: 4077 - DNA, 21 bp, Artificial Sequence
  Description of Artificial Sequence:  synthetic
  misc_feature (4)..(8): 2'-deoxy-2'-fluoro
  misc_feature (9)..(9): 2'-O-methyl
  misc_feature (10)..(10): 2'-deoxy-2'-fluoro
  misc_feature (11)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
guguuuuugcaggaacauutt

SEQ ID NO: 4078 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(11): 2'-O-methyl
  misc_feature (12)..(12): 2'-deoxy-2'-fluoro
  misc_feature (13)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
cuguguuuuugcaggaacatt

SEQ ID NO: 4079 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(11): 2'-deoxy-2'-fluoro
  misc_feature (12)..(12): 2'-O-methyl
  misc_feature (13)..(13): 2'-deoxy-2'-fluoro
  misc_feature (14)..(18): 2'-O-methyl
  misc_feature (19)..(19): 2'-deoxy-2'-fluoro
  misc_feature (1)..(19): ribonucleotide modified as described
ucuguguuuuugcaggaactt

SEQ ID NO: 4080 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(12): 2'-deoxy-2'-fluoro
  misc_feature (13)..(13): 2'-O-methyl
  misc_feature (14)..(14): 2'-deoxy-2'-fluoro
  misc_feature (15)..(19): 2'-O-methyl
  misc_feature (1)..(19): ribonucleotide modified as described
gucuguguuuuugcaggaatt

SEQ ID NO: 4081 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(13): 2'-deoxy-2'-fluoro
  misc_feature (14)..(14): 2'-O-methyl
  misc_feature (15)..(15): 2'-deoxy-2'-fluoro
  misc_feature (16)..(19): 2'-O-methyl
  misc_feature (1)..(19): ribonucleotide modified as described
agucuguguuuuugcaggatt

SEQ ID NO: 4082 - DNA, 21 bp, Artificial Sequence
  Description of Artificial Sequence:  synthetic
  misc_feature (4)..(6): 2'-O-methyl
  misc_feature (7)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
cgcgagucuguguuuuugctt

SEQ ID NO: 4083 - DNA, 21 bp, Artificial Sequence
  Description of Artificial Sequence:  synthetic
  misc_feature (4)..(4): 2'-deoxy-2'-fluoro
  misc_feature (5)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(18): 2'-deoxy-2'-fluoro
  misc_feature (19)..(19): 2'-O-methyl
  misc_feature (1)..(19): ribonucleotide modified as described
acgcgagucuguguuuuugtt

SEQ ID NO: 4084 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(10): 2'-O-methyl
  misc_feature (11)..(13): 2'-deoxy-2'-fluoro
  misc_feature (14)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
gcaacgcgagucuguguuutt

SEQ ID NO: 4085 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(14): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
ccuugcaacgcgagucugutt

SEQ ID NO: 4086 - DNA, 21 bp, Artificial Sequence
  Description of Artificial Sequence:  synthetic
  misc_feature (4)..(4): 2'-O-methyl
  misc_feature (5)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (14)..(14): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
cucgccuugcaacgcgagutt

SEQ ID NO: 4087 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (1)..(19): ribonucleotide modified as described
agcugccucgccuugcaactt

SEQ ID NO: 4088 - DNA, 21 bp, Artificial Sequence
  Description of Artificial Sequence:  synthetic
  misc_feature (4)..(6): 2'-O-methyl
  misc_feature (7)..(8): 2'-deoxy-2'-fluoro
  misc_feature (9)..(9): 2'-O-methyl
  misc_feature (10)..(13): 2'-deoxy-2'-fluoro
  misc_feature (14)..(14): 2'-O-methyl
  misc_feature (15)..(18): 2'-deoxy-2'-fluoro
  misc_feature (19)..(19): 2'-O-methyl
  misc_feature (1)..(19): ribonucleotide modified as described
cucaagcugccucgccuugtt

SEQ ID NO: 4089 - DNA, 21 bp, Artificial Sequence
  Description of Artificial Sequence:  synthetic
  misc_feature (4)..(5): 2'-deoxy-2'-fluoro
  misc_feature (6)..(8): 2'-O-methyl
  misc_feature (9)..(10): 2'-deoxy-2'-fluoro
  misc_feature (11)..(11): 2'-O-methyl
  misc_feature (12)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
aacucaagcugccucgccutt

SEQ ID NO: 4090 - DNA, 21 bp, Artificial Sequence
  Description of Artificial Sequence:  synthetic
  misc_feature (4)..(5): 2'-deoxy-2'-fluoro
  misc_feature (6)..(7): 2'-O-methyl
  misc_feature (8)..(10): 2'-deoxy-2'-fluoro
  misc_feature (11)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
cguuuaacucaagcugccutt

SEQ ID NO: 4091 - DNA, 21 bp, Artificial Sequence
  Description of Artificial Sequence:  synthetic
  misc_feature (4)..(6): 2'-deoxy-2'-fluoro
  misc_feature (7)..(8): 2'-O-methyl
  misc_feature (9)..(11): 2'-deoxy-2'-fluoro
  misc_feature (12)..(14): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
ucguuuaacucaagcugcctt

SEQ ID NO: 4092 - DNA, 21 bp, Artificial Sequence
  Description of Artificial Sequence:  synthetic
  misc_feature (4)..(4): 2'-O-methyl
  misc_feature (5)..(7): 2'-deoxy-2'-fluoro
  misc_feature (8)..(9): 2'-O-methyl
  misc_feature (10)..(12): 2'-deoxy-2'-fluoro
  misc_feature (13)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
uucguuuaacucaagcugctt

SEQ ID NO: 4093 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (9)..(10): 2'-O-methyl
  misc_feature (11)..(13): 2'-deoxy-2'-fluoro
  misc_feature (14)..(16): 2'-O-methyl
  misc_feature (17)..(18): 2'-deoxy-2'-fluoro
  misc_feature (19)..(19): 2'-O-methyl
  misc_feature (1)..(19): ribonucleotide modified as described
guucguuuaacucaagcugtt

SEQ ID NO: 4094 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(9): 2'-deoxy-2'-fluoro
  misc_feature (10)..(11): 2'-O-methyl
  misc_feature (12)..(14): 2'-deoxy-2'-fluoro
  misc_feature (15)..(17): 2'-O-methyl
  misc_feature (18)..(19): 2'-deoxy-2'-fluoro
  misc_feature (1)..(19): ribonucleotide modified as described
cguucguuuaacucaagcutt

SEQ ID NO: 4095 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(15): 2'-deoxy-2'-fluoro
  misc_feature (16)..(17): 2'-O-methyl
  misc_feature (18)..(19): 2'-deoxy-2'-fluoro
  misc_feature (1)..(19): ribonucleotide modified as described
caaguacguucguuuaacutt

SEQ ID NO: 4096 - DNA, 21 bp, Artificial Sequence
  Description of Artificial Sequence:  synthetic
  misc_feature (4)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(13): 2'-deoxy-2'-fluoro
  misc_feature (14)..(14): 2'-O-methyl
  misc_feature (15)..(17): 2'-deoxy-2'-fluoro
  misc_feature (18)..(19): 2'-O-methyl
  misc_feature (1)..(19): ribonucleotide modified as described
ugcaaguacguucguuuaatt

SEQ ID NO: 4097 - DNA, 21 bp, Artificial Sequence
  Description of Artificial Sequence:  synthetic
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(18): 2'-deoxy-2'-fluoro
  misc_feature (19)..(19): 2'-O-methyl
  misc_feature (1)..(19): ribonucleotide modified as described
cugcaaguacguucguuuatt

SEQ ID NO: 4098 - DNA, 21 bp, Artificial Sequence
  Description of Artificial Sequence:  synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
ucugcaaguacguucguuutt

SEQ ID NO: 4099 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
aucugcaaguacguucguutt

SEQ ID NO: 4100 - DNA, 21 bp, Artificial Sequence
  Description of Artificial Sequence:  synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(13): 2'-deoxy-2'-fluoro
  misc_feature (14)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
uugucacaucugcaaguactt

SEQ ID NO: 4101 - DNA, 21 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (1)..(19): ribonucleotide modified as described
cuugucacaucugcaaguatt

SEQ ID NO: 4102 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(13): 2'-deoxy-2'-fluoro
  misc_feature (14)..(14): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (1)..(19): ribonucleotide modified as described
gcuugucacaucugcaagutt

SEQ ID NO: 4103 - DNA, 21 bp, Artificial Sequence
  Description of Artificial Sequence:  synthetic
  misc_feature (1)..(2): 2'-deoxy
  misc_feature (3)..(3): 2'-deoxy-2'-fluoro
  misc_feature (4)..(4): 2'-deoxy
  misc_feature (5)..(7): 2'-deoxy-2'-fluoro
  misc_feature (8)..(8): 2'-deoxy
  misc_feature (9)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (1)..(19): ribonucleotide modified as described
agcauuuguuuguacaagatt

SEQ ID NO: 4104 - DNA, 21 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (1)..(19): ribonucleotide modified as described
ucuuguacaaacaaaugcutt

SEQ ID NO: 4105 - DNA, 21 bp, Artificial Sequence
  Description of Artificial Sequence:  synthetic
  misc_feature (4)..(8): 2'-deoxy-2'-fluoro
  misc_feature (9)..(14): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (1)..(19): ribonucleotide modified as described
guacuccuggaagaugucctt

SEQ ID NO: 4106 - DNA, 26 bp, Artificial Sequence
  Description of Artificial Sequence:  synthetic
  misc_feature (1)..(24): ribonucleotide modified as described
caauuagaguggcagugagcaaagtt

SEQ ID NO: 4107 - DNA, 27 bp, Artificial Sequence
  Description of Artificial Sequence:  synthetic
  misc_feature (1)..(25): ribonucleotide modified as described
acaauuagaguggcagugagcaaagtt

SEQ ID NO: 4108 - DNA, 28 bp, Artificial Sequence
  Description of Artificial Sequence:  synthetic
  misc_feature (1)..(26): ribonucleotide modified as described
gacaauuagaguggcagugagcaaagtt

SEQ ID NO: 4109 - DNA, 35 bp, Artificial Sequence
  Description of Artificial Sequence:  synthetic
  misc_feature (1)..(33): ribonucleotide modified as described
ugugccagcaguccagcauuuguuuguacaagatt

SEQ ID NO: 4110 - DNA, 28 bp, Artificial Sequence
  Description of Artificial Sequence:  synthetic
  misc_feature (1)..(26): ribonucleotide modified as described
uugguauagagacggggucagagagatt

SEQ ID NO: 4111 - DNA, 26 bp, Artificial Sequence
  Description of Artificial Sequence:  synthetic
  misc_feature (1)..(24): ribonucleotide modified as described
cuuugcucacugccacucuaauugtt

SEQ ID NO: 4112 - DNA, 27 bp, Artificial Sequence
  Description of Artificial Sequence:  synthetic
  misc_feature (1)..(25): ribonucleotide modified as described
cuuugcucacugccacucuaauugutt

SEQ ID NO: 4113 - DNA, 28 bp, Artificial Sequence
  Description of Artificial Sequence:  synthetic
  misc_feature (1)..(26): ribonucleotide modified as described
cuuugcucacugccacucuaauuguctt

SEQ ID NO: 4114 - DNA, 35 bp, Artificial Sequence
  Description of Artificial Sequence:  synthetic
  misc_feature (1)..(335): ribonucleotide modified as described
ucuuguacaaacaaaugcuggacugcuggcacatt

SEQ ID NO: 4115 - DNA, 28 bp, Artificial Sequence
  Description of Artificial Sequence:  synthetic
  misc_feature (1)..(26): ribonucleotide modified as described
ucucucugaccccgucucuauaccaatt

SEQ ID NO: 4116 - DNA, 40 bp, Artificial Sequence
  Description of Artificial Sequence:  synthetic
  misc_feature (1)..(38): ribonucleotide modified as described
ugugccagcaguccagcauugugaaugcagaccaaagatt

SEQ ID NO: 4117 - DNA, 40 bp, Artificial Sequence
  Description of Artificial Sequence:  synthetic
  misc_feature (1)..(38): ribonucleotide modified as described
ucuuuggucugcauucacaaugcuggacugcuggcacatt

SEQ ID NO: 4118 - DNA, 36 bp, Artificial Sequence
  Description of Artificial Sequence:  synthetic
  misc_feature (1)..(34): ribonucleotide modified as described
ugugccagcaguccagcugaaugcagaccaaagatt

SEQ ID NO: 4119 - DNA, 36 bp, Artificial Sequence
  Description of Artificial Sequence:  synthetic
  misc_feature (1)..(34): ribonucleotide modified as described
ucuuuggucugcauucagcuggacugcuggcacatt

SEQ ID NO: 4120 - DNA, 40 bp, Artificial Sequence
  Description of Artificial Sequence:  synthetic
  misc_feature (1)..(38): ribonucleotide modified as described
ugugccagcaguccagcaugaaugcagaccaaagaaagtt

SEQ ID NO: 4121 - DNA, 40 bp, Artificial Sequence
  Description of Artificial Sequence:  synthetic
  misc_feature (1)..(38): ribonucleotide modified as described
cuuucuuuggucugcauucaugcuggacugcuggcacatt

SEQ ID NO: 4122 - DNA, 40 bp, Artificial Sequence
  Description of Artificial Sequence:  synthetic
  misc_feature (1)..(38): ribonucleotide modified as described
ugugccagcaguccagcaugugaaugcagaccaaagaatt

SEQ ID NO: 4123 - DNA, 40 bp, Artificial Sequence
  Description of Artificial Sequence:  synthetic
  misc_feature (1)..(38): ribonucleotide modified as described
uucuuuggucugcauucacaugcuggacugcuggcacatt

SEQ ID NO: 4124 - DNA, 42 bp, Artificial Sequence
  Description of Artificial Sequence:  synthetic
  misc_feature (1)..(19): ribonucleotide modified as described
  misc_feature (23)..(23): hexethelyne glycol spacer
  misc_feature (22)..(40): ribonucleotide modified as described
ggacaucuuccaggaguacttgaacugaguuuaaaaggcatt

SEQ ID NO: 4125 - DNA, 42 bp, Artificial Sequence
  Description of Artificial Sequence:  synthetic
  misc_feature (1)..(19): ribonucleotide modified as described
  misc_feature (23)..(23): hexethelyne glycol spacer
  misc_feature (22)..(40): ribonucleotide modified as described
gugaaugcagaccaaagaattgaacugaguuuaaaaggcatt

SEQ ID NO: 4126 - DNA, 42 bp, Artificial Sequence
  Description of Artificial Sequence:  synthetic
  misc_feature (1)..(19): ribonucleotide modified as described
  misc_feature (23)..(23): hexethelyne glycol spacer
  misc_feature (22)..(40): ribonucleotide modified as described
ugagcauggaagaggauucttgaacugaguuuaaaaggcatt

SEQ ID NO: 4127 - DNA, 42 bp, Artificial Sequence
  Description of Artificial Sequence:  synthetic
  misc_feature (1)..(19): ribonucleotide modified as described
  misc_feature (23)..(23): hexethelyne glycol spacer
  misc_feature (22)..(40): ribonucleotide modified as described
gaacugaguuuaaaaggcattgugaaugcagaccaaagaatt

SEQ ID NO: 4128 - DNA, 42 bp, Artificial Sequence
  Description of Artificial Sequence:  synthetic
  misc_feature (1)..(19): ribonucleotide modified as described
  misc_feature (23)..(23): hexethelyne glycol spacer
  misc_feature (22)..(40): ribonucleotide modified as described
augcuggacugcuggcacattgugaaugcagaccaaagaatt

SEQ ID NO: 4129 - DNA, 42 bp, Artificial Sequence; identical to SEQ ID NO: 4128
  Description of Artificial Sequence:  synthetic
  misc_feature (1)..(19): ribonucleotide modified as described
  misc_feature (23)..(23): C12 spacer
  misc_feature (22)..(40): ribonucleotide modified as described

SEQ ID NO: 4130 - DNA, 43 bp, Artificial Sequence
  Description of Artificial Sequence:  synthetic
  misc_feature (1)..(19): ribonucleotide modified as described
  misc_feature (23)..(23): tetraethelyne glycol spacer
  misc_feature (22)..(41): ribonucleotide modified as described
augcuggacugcuggcacattygugaaugcagaccaaagaatt

SEQ ID NO: 4131 - DNA, 43 bp, Artificial Sequence
  Description of Artificial Sequence:  synthetic
  misc_feature (1)..(19): ribonucleotide modified as described
  misc_feature (23)..(23): C3 spacer
  misc_feature (23)..(41): ribonucleotide modified as described
augcuggacugcuggcacatttgugaaugcagaccaaagaatt

SEQ ID NO: 4132 - DNA, 42 bp, Artificial Sequence; identical to SEQ ID NO: 4128
  Description of Artificial Sequence:  synthetic
  misc_feature (1)..(19): ribonucleotide modified as described
  misc_feature (23)..(24): hexethelyne glycol spacer
  misc_feature (22)..(40): ribonucleotide modified as described

SEQ ID NO: 4133 - DNA, 31 bp, Artificial Sequence
  Description of Artificial Sequence:  synthetic
  misc_feature (1)..(29): ribonucleotide modified as described
uuuaagaaaaaagaagaggaagcuccugatt

SEQ ID NO: 4134 - DNA, 32 bp, Artificial Sequence
  Description of Artificial Sequence:  synthetic
  misc_feature (1)..(30): ribonucleotide modified as described
uguuuaagaaaaaagaagaaggaaacagaatt

SEQ ID NO: 4135 - DNA, 31 bp, Artificial Sequence
  Description of Artificial Sequence:  synthetic
  misc_feature (1)..(29): ribonucleotide modified as described
uaaauuaaaacgagaaacauucuuuuauctt

SEQ ID NO: 4136 - DNA, 31 bp, Artificial Sequence
  Description of Artificial Sequence:  synthetic
  misc_feature (1)..(29): ribonucleotide modified as described
ucggcccgauucaagugggccuuggaucgtt

SEQ ID NO: 4137 - DNA, 31 bp, Artificial Sequence
  Description of Artificial Sequence:  synthetic
  misc_feature (1)..(29): ribonucleotide modified as described
gucggcccgauucaaguggccagaggcautt

SEQ ID NO: 4138 - DNA, 31 bp, Artificial Sequence
  Description of Artificial Sequence:  synthetic
  misc_feature (1)..(29): ribonucleotide modified as described
uuccucgacuucucucugguuguguaugutt

SEQ ID NO: 4139 - DNA, 29 bp, Artificial Sequence
  Description of Artificial Sequence:  synthetic
  misc_feature (1)..(27): ribonucleotide modified as described
ucucucugaccccgucucuauaccaactt

SEQ ID NO: 4140 - DNA, 31 bp, Artificial Sequence
  Description of Artificial Sequence:  synthetic
  misc_feature (1)..(29): ribonucleotide modified as described
ucagcgcgacuggucagcuacugggacactt

SEQ ID NO: 4141 - DNA, 31 bp, Artificial Sequence
  Description of Artificial Sequence:  synthetic
  misc_feature (1)..(29): ribonucleotide modified as described
aaguuggacgaaaaguuuccacuugacactt

SEQ ID NO: 4142 - DNA, 33 bp, Artificial Sequence
  Description of Artificial Sequence:  synthetic
  misc_feature (1)..(31): ribonucleotide modified as described
ucuccggcucgggcugugggaaaucuucucctt

SEQ ID NO: 4143 - DNA, 31 bp, Artificial Sequence
  Description of Artificial Sequence:  synthetic
  misc_feature (1)..(29): ribonucleotide modified as described
agacagcagaaaguucaugagccuggaaatt

SEQ ID NO: 4144 - DNA, 33 bp, Artificial Sequence
  Description of Artificial Sequence:  synthetic
  misc_feature (1)..(31): ribonucleotide modified as described
cugggaccacuuggcauggaguucuuggcautt

SEQ ID NO: 4145 - DNA, 33 bp, Artificial Sequence
  Description of Artificial Sequence:  synthetic
  misc_feature (1)..(31): ribonucleotide modified as described
acacaggauggcuugaagaugggaaggauuutt

SEQ ID NO: 4146 - DNA, 29 bp, Artificial Sequence
  Description of Artificial Sequence:  synthetic
  misc_feature (1)..(27): ribonucleotide modified as described
guuugauccgcauaaucugggacaguatt

SEQ ID NO: 4147 - DNA, 30 bp, Artificial Sequence
  Description of Artificial Sequence:  synthetic
  misc_feature (1)..(28): ribonucleotide modified as described
gguuugauccgcauaaucugggacaguatt

SEQ ID NO: 4148 - DNA, 31 bp, Artificial Sequence
  Description of Artificial Sequence:  synthetic
  misc_feature (1)..(29): ribonucleotide modified as described
uaggaagcucaucucuccuguggauuccutt

SEQ ID NO: 4149 - DNA, 34 bp, Artificial Sequence
  Description of Artificial Sequence:  synthetic
  misc_feature (1)..(32): ribonucleotide modified as described
uuuguugugcuguaggaagcucugaugauguctt

SEQ ID NO: 4150 - DNA, 31 bp, Artificial Sequence
  Description of Artificial Sequence:  synthetic
  misc_feature (1)..(29): ribonucleotide modified as described
auucacauuuguugugcuguuucugacuctt

SEQ ID NO: 4151 - DNA, 30 bp, Artificial Sequence
  Description of Artificial Sequence:  synthetic
  misc_feature (1)..(28): ribonucleotide modified as described
uuggucugcauucacauuuuguaucagutt

SEQ ID NO: 4152 - DNA, 31 bp, Artificial Sequence
  Description of Artificial Sequence:  synthetic
  misc_feature (1)..(29): ribonucleotide modified as described
ucaggagcuuccucuucuuuuuucuuaaatt

SEQ ID NO: 4153 - DNA, 32 bp, Artificial Sequence
  Description of Artificial Sequence:  synthetic
  misc_feature (1)..(30): ribonucleotide modified as described
uucuguuuccuucuucuuuuuucuuaaacatt

SEQ ID NO: 4154 - DNA, 31 bp, Artificial Sequence
  Description of Artificial Sequence:  synthetic
  misc_feature (1)..(29): ribonucleotide modified as described
gauaaaagaauguuucucguuuuaauuuatt

SEQ ID NO: 4155 - DNA, 31 bp, Artificial Sequence
  Description of Artificial Sequence:  synthetic
  misc_feature (1)..(29): ribonucleotide modified as described
cgauccaaggcccacuugaaucgggccgatt

SEQ ID NO: 4156 - DNA, 31 bp, Artificial Sequence
  Description of Artificial Sequence:  synthetic
  misc_feature (1)..(29): ribonucleotide modified as described
augccucuggccacuugaaucgggccgactt

SEQ ID NO: 4157 - DNA, 31 bp, Artificial Sequence
  Description of Artificial Sequence:  synthetic
  misc_feature (1)..(29): ribonucleotide modified as described
acauacacaaccagagagaagucgaggaatt

SEQ ID NO: 4158 - DNA, 29 bp, Artificial Sequence
  Description of Artificial Sequence:  synthetic
  misc_feature (1)..(27): ribonucleotide modified as described
guugguauagagacggggucagagagatt

SEQ ID NO: 4159 - DNA, 31 bp, Artificial Sequence
  Description of Artificial Sequence:  synthetic
  misc_feature (1)..(29): ribonucleotide modified as described
gugucccaguagcugaccagucgcgcugatt

SEQ ID NO: 4160 - DNA, 31 bp, Artificial Sequence
  Description of Artificial Sequence:  synthetic
  misc_feature (1)..(29): ribonucleotide modified as described
gugucaaguggaaacuuuucguccaacuutt

SEQ ID NO: 4161 - DNA, 33 bp, Artificial Sequence
  Description of Artificial Sequence:  synthetic
  misc_feature (1)..(31): ribonucleotide modified as described
ggagaagauuucccacagcccgagccggagatt

SEQ ID NO: 4162 - DNA, 31 bp, Artificial Sequence
  Description of Artificial Sequence:  synthetic
  misc_feature (1)..(29): ribonucleotide modified as described
uuuccaggcucaugaacuuucugcugucutt

SEQ ID NO: 4163 - DNA, 33 bp, Artificial Sequence
  Description of Artificial Sequence:  synthetic
  misc_feature (1)..(31): ribonucleotide modified as described
augccaagaacuccaugccaaguggucccagtt

SEQ ID NO: 4164 - DNA, 33 bp, Artificial Sequence
  Description of Artificial Sequence:  synthetic
  misc_feature (1)..(31): ribonucleotide modified as described
aaauccuucccaucuucaagccauccugugutt

SEQ ID NO: 4165 - DNA, 29 bp, Artificial Sequence
  Description of Artificial Sequence:  synthetic
  misc_feature (1)..(27): ribonucleotide modified as described
uacugucccagauuaugcggaucaaactt

SEQ ID NO: 4166 - DNA, 30 bp, Artificial Sequence
  Description of Artificial Sequence:  synthetic
  misc_feature (1)..(28): ribonucleotide modified as described
uacugucccagauuaugcggaucaaacctt

SEQ ID NO: 4167 - DNA, 31 bp, Artificial Sequence
  Description of Artificial Sequence:  synthetic
  misc_feature (1)..(29): ribonucleotide modified as described
aggaauccacaggagagaugagcuuccuatt

SEQ ID NO: 4168 - DNA, 34 bp, Artificial Sequence
  Description of Artificial Sequence:  synthetic
  misc_feature (1)..(32): ribonucleotide modified as described
gacaucaucagagcuuccuacagcacaacaaatt

SEQ ID NO: 4169 - DNA, 31 bp, Artificial Sequence
  Description of Artificial Sequence:  synthetic
  misc_feature (1)..(29): ribonucleotide modified as described
gagucagaaacagcacaacaaaugugaautt

SEQ ID NO: 4170 - DNA, 30 bp, Artificial Sequence
  Description of Artificial Sequence:  synthetic
  misc_feature (1)..(28): ribonucleotide modified as described
acugauacaaaaugugaaugcagaccaatt

SEQ ID NO: 4171 - DNA, 40 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-deoxy
  misc_feature (22)..(22): 2'-deoxy-2'-fluoro
  misc_feature (23)..(23): 2'-deoxy
  misc_feature (24)..(26): 2'-deoxy-2'-fluoro
  misc_feature (27)..(27): 2'-deoxy
  misc_feature (29)..(30): 2'-deoxy-2'-fluoro
  misc_feature (31)..(31): 2'-deoxy
  misc_feature (32)..(32): 2'-deoxy-2'-fluoro
  misc_feature (33)..(33): 2'-deoxy
  misc_feature (34)..(34): 2'-deoxy-2'-fluoro
  misc_feature (35)..(38): 2'-deoxy
  misc_feature (1)..(38): ribonucleotide modified as described
  misc_feature (40)..(40): 3'-3 attached terminal deoxyabasic moeity
ugugccagcaguccagcauagcauuuguuuguacaagatt

SEQ ID NO: 4172 - DNA, 40 bp, Artificial Sequence
  Description of Artificial Sequence:  synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(20): 2'-deoxy
  misc_feature (21)..(21): 2'-deoxy-2'-fluoro
  misc_feature (22)..(22): 2'-deoxy
  misc_feature (23)..(24): 2'-deoxy-2'-fluoro
  misc_feature (25)..(27): 2'-deoxy
  misc_feature (28)..(29): 2'-deoxy-2'-fluoro
  misc_feature (30)..(30): 2'-deoxy
  misc_feature (31)..(32): 2'-deoxy-2'-fluoro
  misc_feature (33)..(34): 2'-deoxy
  misc_feature (35)..(35): 2'-deoxy-2'-fluoro
  misc_feature (36)..(36): 2'-deoxy
  misc_feature (37)..(37): 2'-deoxy-2'-fluoro
  misc_feature (38)..(38): 2'-deoxy
  misc_feature (1)..(38): ribonucleotide modified as described
  misc_feature (40)..(40): 3'-3 attached terminal deoxyabasic moeity
ucuuguacaaacaaaugcuaugcuggacugcuggcacatt

SEQ ID NO: 4173 - DNA, 42 bp, Artificial Sequence; identical to SEQ ID NO: 4124
  Description of Artificial Sequence:  synthetic
  misc_feature (1)..(1): 5'-3 attached terminal deoxyabasic moeity
  misc_feature (4)..(4): 2'-deoxy-2'-fluoro
  misc_feature (6)..(11): 2'-deoxy-2'-fluoro
  misc_feature (17)..(17): 2'-deoxy-2'-fluoro
  misc_feature (19)..(19): 2'-deoxy-2'-fluoro
  misc_feature (1)..(19): ribonucleotide modified as described
  misc_feature (21)..(21): hexethelyne glycol spacer
  misc_feature (22)..(24): 2'-deoxy
  misc_feature (25)..(26): 2'-deoxy-2'-fluoro
  misc_feature (27)..(29): 2'-deoxy
  misc_feature (30)..(32): 2'-deoxy-2'-fluoro
  misc_feature (33)..(38): 2'-deoxy
  misc_feature (39)..(39): 2'-deoxy-2'-fluoro
  misc_feature (40)..(40): 2'-deoxy
  misc_feature (22)..(40): ribonucleotide modified as described
  misc_feature (42)..(42): 3'-3 attached terminal deoxyabasic moeity

SEQ ID NO: 4174 - DNA, 42 bp, Artificial Sequence; identical to SEQ ID NO: 4125
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(11): 2'-deoxy
  misc_feature (12)..(13): 2'-deoxy-2'-fluoro
  misc_feature (14)..(19): 2'-deoxy
  misc_feature (1)..(19): ribonucleotide modified as described
  misc_feature (21)..(21): hexethelyne glycol spacer
  misc_feature (22)..(24): 2'-deoxy
  misc_feature (25)..(26): 2'-deoxy-2'-fluoro
  misc_feature (27)..(29): 2'-deoxy
  misc_feature (30)..(32): 2'-deoxy-2'-fluoro
  misc_feature (33)..(38): 2'-deoxy
  misc_feature (39)..(39): 2'-deoxy-2'-fluoro
  misc_feature (40)..(40): 2'-deoxy
  misc_feature (22)..(40): ribonucleotide modified as described
  misc_feature (42)..(42): 3'-3 attached terminal deoxyabasic moeity

SEQ ID NO: 4175 - DNA, 42 bp, Artificial Sequence; identical to SEQ ID NO: 4127
  Description of Artificial Sequence:  synthetic
  misc_feature (1)..(1): 5'-3 attached terminal deoxyabasic moeity
  misc_feature (1)..(3): 2'-deoxy
  misc_feature (4)..(5): 2'-deoxy-2'-fluoro
  misc_feature (6)..(8): 2'-deoxy
  misc_feature (9)..(11): 2'-deoxy-2'-fluoro
  misc_feature (12)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): hexethelyne glycol spacer
  misc_feature (22)..(22): 2'-deoxy
  misc_feature (23)..(23): 2'-deoxy-2'-fluoro
  misc_feature (24)..(26): 2'-deoxy
  misc_feature (27)..(27): 2'-deoxy-2'-fluoro
  misc_feature (28)..(28): 2'-deoxy
  misc_feature (29)..(29): 2'-deoxy-2'-fluoro
  misc_feature (30)..(32): 2'-deoxy
  misc_feature (33)..(34): 2'-deoxy-2'-fluoro
  misc_feature (35)..(40): 2'-deoxy
  misc_feature (22)..(40): ribonucleotide modified as described
  misc_feature (42)..(42): 3'-3 attached terminal deoxyabasic moeity

SEQ ID NO: 4176 - DNA, 42 bp, Artificial Sequence; identical to SEQ ID NO: 4128
  Description of Artificial Sequence:  synthetic
  misc_feature (1)..(1): 5'-3 attached terminal deoxyabasic moeity
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(8): 2'-deoxy
  misc_feature (9)..(10): 2'-deoxy-2'-fluoro
  misc_feature (11)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (1)..(19): ribonucleotide modified as described
  misc_feature (21)..(21): hexethelyne glycol spacer
  misc_feature (22)..(22): 2'-deoxy
  misc_feature (23)..(23): 2'-deoxy-2'-fluoro
  misc_feature (24)..(26): 2'-deoxy
  misc_feature (27)..(27): 2'-deoxy-2'-fluoro
  misc_feature (28)..(28): 2'-deoxy
  misc_feature (29)..(29): 2'-deoxy-2'-fluoro
  misc_feature (30)..(32): 2'-deoxy
  misc_feature (33)..(34): 2'-deoxy-2'-fluoro
  misc_feature (35)..(40): 2'-deoxy
  misc_feature (22)..(40): ribonucleotide modified as described
  misc_feature (42)..(42): 3'-3 attached terminal deoxyabasic moeity

SEQ ID NO: 4177 - DNA, 52 bp, Artificial Sequence
  Description of Artificial Sequence:  synthetic
  misc_feature (1)..(19): ribonucleotide modified as described
  misc_feature (22)..(26): n stands for thymidine
  misc_feature (28)..(29): ribonucleotide modified as described
  misc_feature (31)..(50): ribonucleotide modified as described
augcuggacugcuggcacattgaucatcgtagugaaugcagaccaaagaatt

SEQ ID NO: 4178 - DNA, 48 bp, Artificial Sequence
  Description of Artificial Sequence:  synthetic
  misc_feature (1)..(19): ribonucleotide modified as described
  misc_feature (22)..(26): ribonucleotide modified as described
  misc_feature (28)..(46): ribonucleotide modified as described
augcuggacugcuggcacattgaucatgugaaugcagaccaaagaatt

SEQ ID NO: 4179 - DNA, 45 bp, Artificial Sequence
  Description of Artificial Sequence:  synthetic
  misc_feature (1)..(19): ribonucleotide modified as described
  misc_feature (22)..(43): ribonucleotide modified as described
augcuggacugcuggcacattgaugugaaugcagaccaaagaatt

SEQ ID NO: 4180 - DNA, 42 bp, Artificial Sequence; identical to SEQ ID NO: 4128
  Description of Artificial Sequence:  synthetic
  misc_feature (1)..(19): ribonucleotide modified as described
  misc_feature (22)..(40): ribonucleotide modified as described

SEQ ID NO: 4181 - DNA, 42 bp, Artificial Sequence
  Description of Artificial Sequence:  synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (22)..(22): 2'-deoxy
  misc_feature (23)..(23): 2'-deoxy-2'-fluoro
  misc_feature (24)..(26): 2'-deoxy
  misc_feature (27)..(27): 2'-deoxy-2'-fluoro
  misc_feature (28)..(28): 2'-deoxy
  misc_feature (29)..(29): 2'-deoxy-2'-fluoro
  misc_feature (30)..(32): 2'-deoxy
  misc_feature (33)..(34): 2'-deoxy-2'-fluoro
  misc_feature (35)..(40): 2'-deoxy
  misc_feature (22)..(40): ribonucleotide modified as described
  misc_feature (42)..(42): 3'-3 attached terminal deoxyabasic moeity
ugugccagcaguccagcauttgugaaugcagaccaaagaatt

SEQ ID NO: 4182 - DNA, 42 bp, Artificial Sequence
  Description of Artificial Sequence:  synthetic
  misc_feature (4)..(6): 2'-deoxy-2'-fluoro
  misc_feature (7)..(8): 2'-O-methyl
  misc_feature (9)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (1)..(19): ribonucleotide modified as described
  misc_feature (22)..(22): 2'-deoxy
  misc_feature (23)..(23): 2'-deoxy-2'-fluoro
  misc_feature (24)..(24): 2'-deoxy
  misc_feature (25)..(26): 2'-deoxy-2'-fluoro
  misc_feature (27)..(29): 2'-deoxy
  misc_feature (30)..(31): 2'-deoxy-2'-fluoro
  misc_feature (32)..(32): 2'-deoxy
  misc_feature (33)..(34): 2'-deoxy-2'-fluoro
  misc_feature (35)..(36): 2'-deoxy
  misc_feature (37)..(37): 2'-deoxy-2'-fluoro
  misc_feature (38)..(38): 2'-deoxy
  misc_feature (39)..(39): 2'-deoxy-2'-fluoro
  misc_feature (40)..(40): 2'-deoxy
  misc_feature (22)..(40): ribonucleotide modified as described
  misc_feature (42)..(42): 3'-3 attached terminal deoxyabasic moeity
uucuuuggucugcauucacttaugcuggacugcuggcacatt

SEQ ID NO: 4183 - DNA, 42 bp, Artificial Sequence; identical to SEQ ID NO: 4127
  Description of Artificial Sequence:  synthetic
  misc_feature (1)..(1): 5'-3 attached terminal deoxyabasic moeity
  misc_feature (1)..(19): ribonucleotide modified as described
  misc_feature (21)..(21): hexethelyne glycol spacer
  misc_feature (22)..(40): ribonucleotide modified as described
  misc_feature (42)..(42): 3'-3 attached terminal deoxyabasic moeity

SEQ ID NO: 4184 - RNA, 38 nt, Artificial Sequence
  Description of Artificial Sequence:  synthetic
  misc_feature (1)..(1): 5'-3 attached terminal deoxyabasic moeity
  misc_feature (38)..(38): 3'-3 attached terminal deoxyabasic moeity
gaacugaguuuaaaaggcagugaaugcagaccaaagaa

SEQ ID NO: 4185 - RNA, 38 nt, Artificial Sequence
  Description of Artificial Sequence:  synthetic
uucuuuggucugcauucacugccuuuuaaacucaguuc

SEQ ID NO: 4186 - DNA, 40 bp, Artificial Sequence
  Description of Artificial Sequence:  synthetic
  misc_feature (1)..(38): ribonucleotide modified as described
  misc_feature (40)..(40): 3'-3 attached terminal deoxyabasic moeity
ugccuuuuaaacucaguucgugaaugcagaccaaagaatt

SEQ ID NO: 4187 - DNA, 40 bp, Artificial Sequence
  Description of Artificial Sequence:  synthetic
  misc_feature (1)..(38): ribonucleotide modified as described
  misc_feature (40)..(40): 3'-3 attached terminal deoxyabasic moeity
uucuuuggucugcauucacgaacugaguuuaaaaggcatt

SEQ ID NO: 4188 - RNA, 30 nt, Artificial Sequence
  Description of Artificial Sequence:  synthetic
  misc_feature (1)..(1): terminal phosphate
  misc_feature (30)..(30): 3'-3 attached terminal deoxyabasic moeity
gugcugggugccuuuuaaaaggcacccagc

SEQ ID NO: 4189 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
gugcugggugccuuuaaaggcacccagc

SEQ ID NO: 4190 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
gugcugggugccuuaaggcacccagc

SEQ ID NO: 4191 - RNA, 27 nt, Artificial Sequence
  Description of Artificial Sequence:  synthetic
  misc_feature (1)..(1): terminal phosphate
  misc_feature (27)..(27): 3'-3 attached terminal deoxyabasic moeity
aaugcuuuaucauauauaugauaaagc

SEQ ID NO: 4192 - RNA, 25 nt, Artificial Sequence
  Description of Artificial Sequence:  synthetic
  misc_feature (1)..(1): terminal phosphate
  misc_feature (25)..(25): 3'-3 attached terminal deoxyabasic moeity
aaugcuuuaucauauaugauaaagc

SEQ ID NO: 4193 - RNA, 23 nt, Artificial Sequence
  Description of Artificial Sequence:  synthetic
  misc_feature (1)..(1): terminal phosphate
  misc_feature (23)..(23): 3'-3 attached terminal deoxyabasic moeity
aaugcuuuaucauaugauaaagc

SEQ ID NO: 4194 - RNA, 24 nt, Artificial Sequence
  Description of Artificial Sequence:  synthetic
  misc_feature (1)..(1): terminal phosphate
  misc_feature (24)..(24): 3'-3 attached terminal deoxyabasic moeity
aaugcuuuaucauaugauaaagca

SEQ ID NO: 4195 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
aaugcuuuaucauauaugauaaagcauu

SEQ ID NO: 4196 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
aaugcuuuaucauaugauaaagcauu

SEQ ID NO: 4197 - RNA, 31 nt, Artificial Sequence
  Description of Artificial Sequence:  synthetic
  misc_feature (1)..(1): terminal phosphate
  misc_feature (31)..(31): 3'-3 attached terminal deoxyabasic moeity
gggugccuuuuaaacucaggaguuuaaaagg

SEQ ID NO: 4198 - RNA, 31 nt, Artificial Sequence
  Description of Artificial Sequence:  synthetic
  misc_feature (1)..(1): terminal phosphate
  misc_feature (31)..(31): 3'-3 attached terminal deoxyabasic moeity
gggugccuuuuaaacucgaguuuaaaaggca

SEQ ID NO: 4199 - RNA, 27 nt, Artificial Sequence
  Description of Artificial Sequence:  synthetic
  misc_feature (1)..(1): terminal phosphate
  misc_feature (27)..(27): 3'-3 attached terminal deoxyabasic moeity
gggugccuuuuaaacuaguuuaaaagg

SEQ ID NO: 4200 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
gggugccuuuuaaacuaguuuaaaaggc

SEQ ID NO: 4201 - RNA, 29 nt, Artificial Sequence
  Description of Artificial Sequence:  synthetic
  misc_feature (1)..(1): terminal phosphate
  misc_feature (29)..(29): 3'-3 attached terminal deoxyabasic moeity
gggugccuuuuaaacuaguuuaaaaggca

SEQ ID NO: 4202 - RNA, 30 nt, Artificial Sequence
  Description of Artificial Sequence:  synthetic
  misc_feature (1)..(1): terminal phosphate
  misc_feature (30)..(30): 3'-3 attached terminal deoxyabasic moeity
gggugccuuuuaaacuaguuuaaaaggcac

SEQ ID NO: 4203 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
gggugccuuuuaaacguuuaaaaggc

SEQ ID NO: 4204 - RNA, 27 nt, Artificial Sequence
  Description of Artificial Sequence:  synthetic
  misc_feature (1)..(1): terminal phosphate
  misc_feature (27)..(27): 3'-3 attached terminal deoxyabasic moeity
gggugccuuuuaaacguuuaaaaggca

SEQ ID NO: 4205 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
gggugccuuuuaaacguuuaaaaggcac

SEQ ID NO: 4206 - RNA, 29 nt, Artificial Sequence
  Description of Artificial Sequence:  synthetic
  misc_feature (1)..(1): terminal phosphate
  misc_feature (29)..(29): 3'-3 attached terminal deoxyabasic moeity
ugcugggugccuuuuaaaaggcacccagc

SEQ ID NO: 4207 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
gcugggugccuuuuaaaaggcacccagc

SEQ ID NO: 4208 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
gcugggugccuuuuaaaaggcacccagc

SEQ ID NO: 4209 - RNA, 27 nt, Artificial Sequence
  Description of Artificial Sequence:  synthetic
  misc_feature (1)..(1): terminal phosphate
  misc_feature (27)..(27): 3'-3 attached terminal deoxyabasic moeity
gcugggugccuuuuaaaaggcacccag

SEQ ID NO: 4210 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
cugggugccuuuuaaaaggcacccag

SEQ ID NO: 4211 - RNA, 25 nt, Artificial Sequence
  Description of Artificial Sequence:  synthetic
  misc_feature (1)..(1): terminal phosphate
  misc_feature (25)..(25): 3'-3 attached terminal deoxyabasic moeity
cugggugccuuuuaaaaggcaccca

SEQ ID NO: 4212 - RNA, 24 nt, Artificial Sequence
  Description of Artificial Sequence:  synthetic
  misc_feature (1)..(1): terminal phosphate
  misc_feature (24)..(24): 3'-3 attached terminal deoxyabasic moeity
ugggugccuuuuaaaaggcaccca

SEQ ID NO: 4213 - RNA, 25 nt, Artificial Sequence
  Description of Artificial Sequence:  synthetic
  misc_feature (1)..(1): terminal phosphate
  misc_feature (25)..(25): 3'-3 attached terminal deoxyabasic moeity
ugggugccuuuuaaaaggcacccan

SEQ ID NO: 4214 - DNA, 25 bp, Artificial Sequence
  Description of Artificial Sequence:  synthetic
  misc_feature (1)..(1): terminal phosphate
  misc_feature (1)..(24): ribonucleotide modified as described
  misc_feature (26)..(26): 3'-3 attached terminal deoxyabasic moeity
ugggugccuuuuaaaaggcacccat

SEQ ID NO: 4215 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
ugcuuuaucauauauaugauaaagca

SEQ ID NO: 4216 - RNA, 25 nt, Artificial Sequence
  Description of Artificial Sequence:  synthetic
  misc_feature (1)..(1): terminal phosphate
  misc_feature (25)..(25): 3'-3 attached terminal deoxyabasic moeity
ugcuuuaucauauauaugauaaagc

SEQ ID NO: 4217 - RNA, 24 nt, Artificial Sequence
  Description of Artificial Sequence:  synthetic
  misc_feature (1)..(1): terminal phosphate
  misc_feature (24)..(24): 3'-3 attached terminal deoxyabasic moeity
gcuuuaucauauauaugauaaagc

SEQ ID NO: 4218 - RNA, 28 nt, Artificial Sequence
  Description of Artificial Sequence:  synthetic
  misc_feature (28)..(28): 3'-3 attached terminal deoxyabasic moeity
aaugcuuuaucauauaugauaaagcauu

SEQ ID NO: 4219 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
aaugcuuuaucauauaugauaaagcauu

SEQ ID NO: 4220 - DNA, 30 bp, Artificial Sequence
  Description of Artificial Sequence:  synthetic
  misc_feature (1)..(1): terminal phosphate
  misc_feature (1)..(28): ribonucleotide modified as described
  misc_feature (30)..(30): 3'-3 attached terminal deoxyabasic moeity
aaugcuuuaucauauaugauaaagcauutt

SEQ ID NO: 4221 - RNA, 27 nt, Artificial Sequence
  Description of Artificial Sequence:  synthetic
  misc_feature (1)..(1): terminal phosphate
  misc_feature (27)..(27): 3'-3 attached terminal deoxyabasic moeity
aaugcuuuaucauauaugauaaagcau

SEQ ID NO: 4222 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
augcuuuaucauauaugauaaagcau

SEQ ID NO: 4223 - RNA, 26 nt, Artificial Sequence
  Description of Artificial Sequence:  synthetic
  misc_feature (1)..(1): terminal phosphate
  misc_feature (26)..(26): 3'-3 attached terminal deoxyabasic moeity
augcuuuaucauauaugauaaagcau

SEQ ID NO: 4224 - DNA, 28 bp, Artificial Sequence
  Description of Artificial Sequence:  synthetic
  misc_feature (1)..(1): terminal phosphate
  misc_feature (1)..(26): n stands for thymidine
  misc_feature (28)..(28): 3'-3 attached terminal deoxyabasic moeity
augcuuuaucauauaugauaaagcautt

SEQ ID NO: 4225 - RNA, 25 nt, Artificial Sequence
  Description of Artificial Sequence:  synthetic
  misc_feature (1)..(1): terminal phosphate
  misc_feature (25)..(25): 3'-3 attached terminal deoxyabasic moeity
augcuuuaucauauaugauaaagca

SEQ ID NO: 4226 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
aaugcuuuaucauauaucuauaagcauu

SEQ ID NO: 4227 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
aaugcuuuuaguuauaugauaaagcauu

SEQ ID NO: 4228 - RNA, 28 nt, Artificial Sequence
  Description of Artificial Sequence:  synthetic
  misc_feature (1)..(1): terminal phosphate
  misc_feature (28)..(28): 3'-3 attached terminal deoxyabasic moeity
aauccuuaaucuuauuugauaaagcauu

SEQ ID NO: 4229 - RNA, 28 nt, Artificial Sequence
  Description of Artificial Sequence:  synthetic
  misc_feature (1)..(1): terminal phosphate
  misc_feature (3)..(3): 2'-deoxy-2'-fluoro
  misc_feature (5)..(8): 2'-deoxy-2'-fluoro
  misc_feature (10)..(11): 2'-deoxy-2'-fluoro
  misc_feature (13)..(13): 2'-deoxy-2'-fluoro
  misc_feature (15)..(15): 2'-deoxy-2'-fluoro
  misc_feature (17)..(17): 2'-deoxy-2'-fluoro
  misc_feature (20)..(20): 2'-deoxy-2'-fluoro
  misc_feature (25)..(25): 2'-deoxy-2'-fluoro
  misc_feature (27)..(28): 2'-deoxy-2'-fluoro
  misc_feature (28)..(28): 3'-3 attached terminal deoxyabasic moeity
aaugcuuuaucauauaugauaaagcauu

SEQ ID NO: 4230 - RNA, 28 nt, Artificial Sequence
  Description of Artificial Sequence:  synthetic
  misc_feature (1)..(1): terminal phosphate
  misc_feature (3)..(3): 2'-deoxy-2'-fluoro
  misc_feature (5)..(8): 2'-deoxy-2'-fluoro
  misc_feature (10)..(11): 2'-deoxy-2'-fluoro
  misc_feature (13)..(13): 2'-deoxy-2'-fluoro
  misc_feature (15)..(15): 2'-deoxy-2'-fluoro
  misc_feature (17)..(17): 2'-deoxy-2'-fluoro
  misc_feature (20)..(20): 2'-deoxy-2'-fluoro
  misc_feature (25)..(25): 2'-deoxy-2'-fluoro
  misc_feature (27)..(28): 2'-deoxy-2'-fluoro
  misc_feature (28)..(28): 3'-3 attached terminal deoxyabasic moeity
aaugcuuuaucauauaugauaaagcauu

SEQ ID NO: 4231 - DNA, 21 bp, Artificial Sequence
  Description of Artificial Sequence:  synthetic
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
  misc_feature (1)..(19): n stands for any ribonucleotide
  misc_feature (20)..(21): n stands for any nucleotide
nnnnnnnnnnnnnnnnnnnnn

SEQ ID NO: 4232 - DNA, 21 bp, Artificial Sequence
  Description of Artificial Sequence:  synthetic
  misc_feature (21)..(21): optionally attached terminal glyceryl, abasic, inverted abasic, inverted nucleotide or other terminal cap moiety
  misc_feature (20)..(21): Optional phosphorothioate or phosphorodithioate internucleotide linkage
  misc_feature (1)..(19): n stands for any ribonucleotide
  misc_feature (20)..(21): n stands for any nucleotide
nnnnnnnnnnnnnnnnnnnnn

SEQ ID NO: 4233 - DNA, 21 bp, Artificial Sequence
  Description of Artificial Sequence:  synthetic
  misc_feature (1)..(19): n stands for any nucleotide wherein any pyrimidine present is 2'-Fluoro and any purine is 2'-O-methyl
  misc_feature (20)..(21): n stands for any nucleotide
  misc_feature (20)..(21): Optional phosphorothioate or phosphorodithioate internucleotide linkage
nnnnnnnnnnnnnnnnnnnnn

SEQ ID NO: 4234 - DNA, 21 bp, Artificial Sequence
  Description of Artificial Sequence:  synthetic
  misc_feature (1)..(19): n stands for any nucleotide wherein any pyrimidine is 2'-Fluoro and any purine is 2'-O-methyl
  misc_feature (20)..(21): n stands for any nucleotide
  misc_feature (20)..(21): Optional phosphorothioate or phosphorodithioate internucleotide linkage
  misc_feature (21)..(21): optionally attached terminal glyceryl, abasic, inverted abasic, inverted nucleotide or other terminal cap moiety
nnnnnnnnnnnnnnnnnnnnn

SEQ ID NO: 4235 - DNA, 21 bp, Artificial Sequence
  Description of Artificial Sequence:  synthetic
  misc_feature (1)..(19): n stands for any nucleotide wherein any pyrimidine is 2'-O-methyl or 2'-Fluoro
  misc_feature (20)..(21): n stands for any nucleotide
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
nnnnnnnnnnnnnnnnnnnnn

SEQ ID NO: 4236 - DNA, 21 bp, Artificial Sequence
  Description of Artificial Sequence:  synthetic
  misc_feature (1)..(19): n stands for any nucleotide wherein any pyrimidine is 2'-Fluoro
  misc_feature (20)..(21): Optional phosphorothioate or phosphorodithioate internucleotide linkage
  misc_feature (20)..(21): n stands for any nucleotide
  misc_feature (21)..(21): optionally attached terminal glyceryl, abasic, inverted abasic, inverted nucleotide or other terminal cap moiety
nnnnnnnnnnnnnnnnnnnnn

SEQ ID NO: 4237 - DNA, 21 bp, Artificial Sequence
  Description of Artificial Sequence:  synthetic
  misc_feature (1)..(19): n stands for any nucleotide wherein any pyrimidine is 2'-Fluoro and any purine nucleotide present is 2'-Deoxy
  misc_feature (20)..(21): n stands for any nucleotide
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
nnnnnnnnnnnnnnnnnnnnn

SEQ ID NO: 4238 - DNA, 21 bp, Artificial Sequence
  Description of Artificial Sequence:  synthetic
  misc_feature (1)..(19): n stands for any nucleotide wherein any pyrimidine is 2'-Fluoro
  misc_feature (20)..(20): Optional phosphorothioate or phosphorodithioate internucleotide linkage
  misc_feature (20)..(21): n stands for any nucleotide
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
nnnnnnnnnnnnnnnnnnnnn

SEQ ID NO: 4239 - DNA, 21 bp, Artificial Sequence
  Description of Artificial Sequence:  synthetic
  misc_feature (1)..(19): n stands for any nucleotide wherein any pyrimidine is 2'-Fluoro and any purine is 2'-deoxy
  misc_feature (20)..(21): n stands for any nucleotide
  misc_feature (21)..(21): optionally attached terminal glyceryl, abasic, inverted abasic, inverted nucleotide or other terminal cap moiety
nnnnnnnnnnnnnnnnnnnnn

SEQ ID NO: 4240 - DNA, 21 bp, Artificial Sequence
  Description of Artificial Sequence:  synthetic
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
  misc_feature (1)..(19): ribonucleotide modified as described
uggaguuacccugaugaaatt

SEQ ID NO: 4241 - DNA, 21 bp, Artificial Sequence
  Description of Artificial Sequence:  synthetic
  misc_feature (21)..(21): optionally attached terminal glyceryl, abasic, inverted abasic, inverted nucleotide or other terminal cap moiety
  misc_feature (20)..(21): Optional phosphorothioate or phosphorodithioate internucleotide linkage
  misc_feature (1)..(19): ribonucleotide modified as described
uuucaucaggguaacuccatt

SEQ ID NO: 4242 - DNA, 21 bp, Artificial Sequence
  Description of Artificial Sequence:  synthetic
  misc_feature (1)..(19): ribonucleotide modified as described
  misc_feature (20)..(21): Optional phosphorothioate or phosphorodithioate internucleotide linkage
  misc_feature (1)..(1): 2'-O-methyl
  misc_feature (6)..(7): 2'-O-methyl
  misc_feature (9)..(12): 2'-O-methyl
  misc_feature (15)..(15): 2'-O-methyl
  misc_feature (2)..(5): 2'-deoxy-2'-fluoro
  misc_feature (8)..(8): 2'-deoxy-2'-fluoro
  misc_feature (13)..(14): 2'-deoxy-2'-fluoro
  misc_feature (16)..(19): 2'-deoxy-2'-fluoro
uggaguuacccugaugaaatt

SEQ ID NO: 4243 - DNA, 21 bp, Artificial Sequence
  Description of Artificial Sequence:  synthetic
  misc_feature (1)..(19): ribonucleotide modified as described
  misc_feature (20)..(21): Optional phosphorothioate or phosphorodithioate internucleotide linkage
  misc_feature (21)..(21): optionally attached terminal glyceryl, abasic, inverted abasic, inverted nucleotide or other terminal cap moiety
  misc_feature (1)..(4): 2'-deoxy-2'-fluoro
  misc_feature (6)..(7): 2'-deoxy-2'-fluoro
  misc_feature (12)..(12): 2'-deoxy-2'-fluoro
  misc_feature (15)..(18): 2'-deoxy-2'-fluoro
  misc_feature (5)..(5): 2'-O-methyl
  misc_feature (4)..(5): 2'-O-methyl
  misc_feature (8)..(11): 2'-O-methyl
  misc_feature (13)..(14): 2'-O-methyl
  misc_feature (19)..(19): 2'-O-methyl
uuucaucaggguaacuccatt

SEQ ID NO: 4244 - DNA, 21 bp, Artificial Sequence
  Description of Artificial Sequence:  synthetic
  misc_feature (1)..(19): ribonucleotide modified as described
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
  misc_feature (1)..(1): 2'-O-methyl or 2'-Fluoro
  misc_feature (6)..(7): 2'-O-methyl or 2'-Fluoro
  misc_feature (9)..(12): 2'-O-methyl or 2'-Fluoro
  misc_feature (15)..(15): 2'-O-methyl or 2'-Fluoro
uggaguuacccugaugaaatt

SEQ ID NO: 4245 - DNA, 21 bp, Artificial Sequence
  Description of Artificial Sequence:  synthetic
  misc_feature (20)..(21): Optional phosphorothioate or phosphorodithioate internucleotide linkage
  misc_feature (1)..(19): ribonucleotide modified as described
  misc_feature (21)..(21): optionally attached terminal glyceryl, abasic, inverted abasic, inverted nucleotide or other terminal cap moiety
  misc_feature (1)..(4): 2'deoxy-2'-Fluoro
  misc_feature (6)..(7): 2'-deoxy-2'-Fluoro
  misc_feature (12)..(12): 2'-deoxy-2'-Fluoro
  misc_feature (15)..(15): 2'-deoxy-2'-Fluoro
  misc_feature (17)..(18): 2'-deoxy-2'-Fluoro
uuucaucaggguaacuccatt

SEQ ID NO: 4246 - DNA, 21 bp, Artificial Sequence
  Description of Artificial Sequence:  synthetic
  misc_feature (1)..(19): ribonucleotide modified as described
  misc_feature (1)..(1): optionally attached terminal abasic, inverted abasic, inverted nucleotide or other terminal cap moiety
  misc_feature (21)..(21): optionally attached terminal abasic, inverted abasic, inverted nucleotide or other terminal cap moiety
  misc_feature (2)..(5): 2'-deoxy
  misc_feature (8)..(8): 2'-deoxy
  misc_feature (13)..(14): 2'-deoxy
  misc_feature (16)..(19): 2'-deoxy
  misc_feature (1)..(1): 2'-deoxy-2'-Fluoro
  misc_feature (6)..(7): 2'-deoxy-2'-Fluoro
  misc_feature (9)..(12): 2'-deoxy-2'-Fluoro
  misc_feature (15)..(15): 2'-deoxy-2'-Fluoro
uggaguuacccugaugaaatt

SEQ ID NO: 4247 - DNA, 21 bp, Artificial Sequence
  Description of Artificial Sequence:  synthetic
  misc_feature (1)..(19): ribonucleotide modified as described
  misc_feature (1)..(1): optionally attached terminal abasic, inverted abasic, inverted nucleotide or other terminal cap moiety
  misc_feature (1)..(1): 2'-deoxy-2'-Fluoro
  misc_feature (6)..(7): 2'-deoxy-2'-Fluoro
  misc_feature (9)..(12): 2'-deoxy-2'-Fluoro
  misc_feature (15)..(15): 2'-deoxy-2'-Fluoro
  misc_feature (21)..(21): optionally attached terminal abasic, inverted abasic, inverted nucleotide or other terminal cap moiety
uggaguuacccugaugaaatt

SEQ ID NO: 4248 - DNA, 21 bp, Artificial Sequence
  Description of Artificial Sequence:  synthetic
  misc_feature (1)..(19): ribonucleotide modified as described
  misc_feature (21)..(21): optionally attached terminal glyceryl, abasic, inverted abasic, inverted nucleotide or other terminal cap moiety
  misc_feature (5)..(5): 2'-deoxy
  misc_feature (8)..(11): 2'-deoxy
  misc_feature (13)..(14): 2'-deoxy
  misc_feature (16)..(16): 2'-deoxy
  misc_feature (19)..(19): 2'-deoxy
  misc_feature (1)..(4): 2'-deoxy-2'-Fluoro
  misc_feature (6)..(7): 2'-deoxy-2'-Fluoro
  misc_feature (12)..(12): 2'-deoxy-2'-Fluoro
  misc_feature (15)..(15): 2'-deoxy-2'-Fluoro
  misc_feature (17)..(18): 2'-deoxy-2'-Fluoro
uuucaucaggguaacuccatt

SEQ ID NO: 4249 - RNA, 14 nt, Artificial Sequence
  Description of Artificial Sequence:  synthetic
auauaucuauuucg

SEQ ID NO: 4250 - RNA, 14 nt, Artificial Sequence
  Description of Artificial Sequence:  synthetic
cgaaauaguauaua

SEQ ID NO: 4251 - RNA, 22 nt, Artificial Sequence
  Description of Artificial Sequence:  synthetic
cgaaauaguauauacuauuucg

SEQ ID NO: 4252 - DNA, 24 bp, Artificial Sequence
  Description of Artificial Sequence:  synthetic
  misc_feature (1)..(22): ribonucleotide modified as described
cgaaauaguauauacuauuucgtt

What we claim is:

1. A method for the treatment of an ocular disease in a subject comprising contacting the subject via intravitreal injection with a double stranded nucleic acid molecule 21-40 nucleotides in length comprising a first strand having SEQ ID NO: 2742 and a second strand having SEQ ID NO: 2745 under conditions suitable to inhibit the expression of VEGFR1 in the subject, wherein the ocular disease is an angiogenic disease.

2. The method of claim 1, wherein said ocular disease is age related macular degeneration (AMD).

3. The method of claim 1, wherein said ocular disease is diabetic retinopathy.

4. The method of claim 1, wherein said treatment comprises intravitreal injection of said double stranded nucleic acid molecule in a pharmaceutically acceptable carrier or diluent.

5. The method of claim 4, wherein said injection takes place every 4 weeks.

6. The method of claim 4, wherein said injection takes place every 6 weeks.

7. The method of claim 4, wherein said injection takes place every 8 weeks.

8. The method of claim 4, wherein said injection takes place every 10 weeks.

9. A method for the treatment of ocular disease in a subject comprising contacting the subject with a double stranded nucleic acid molecule 21-40 nucleotides in length comprising a first strand having SEQ ID NO: 2742 and a second strand having SEQ ID NO: 2745, wherein the treatment comprises administration of the double stranded nucleic acid molecule via periocular injection to an eye of the subject, wherein the ocular disease is an angiogenic disease.

10. The method of claim 9, wherein said ocular disease is age related macular degeneration (AMD).

11. The method of claim 9, wherein said ocular disease is diabetic retinopathy.

12. The method of claim 9, wherein the double stranded nucleic acid molecule is in a pharmaceutically acceptable carrier or diluent.

13. The method of claim 9, wherein said administration takes place every 4 weeks.

14. The method of claim 9, wherein said administration takes place every 6 weeks.

15. The method of claim 9, wherein said administration takes place every 8 weeks.

16. The method of claim 9, wherein said administration takes place every 10 weeks.

* * * * *